US011932676B2

(12) United States Patent
Tarsio et al.

(10) Patent No.: US 11,932,676 B2
(45) Date of Patent: *Mar. 19, 2024

(54) RECOMBINANT KLOTHO PROTEINS AND COMPOSITIONS AND METHODS INVOLVING SAME

(71) Applicant: KLOTHO THERAPEUTICS, INC., Las Vegas, NV (US)

(72) Inventors: Joseph F. Tarsio, Manilus, NY (US); Dinesh Raturi, Eastville, CA (US); James R. Plante, Las Vegas, NV (US)

(73) Assignee: KLOTHO THERAPEUTICS, INC., Las Vegas, NV (US)

( * ) Notice: Subject to any disclaimer, the term of this patent is extended or adjusted under 35 U.S.C. 154(b) by 0 days.

This patent is subject to a terminal disclaimer.

(21) Appl. No.: 16/462,864

(22) PCT Filed: Nov. 22, 2017

(86) PCT No.: PCT/US2017/063149
§ 371 (c)(1),
(2) Date: May 21, 2019

(87) PCT Pub. No.: WO2018/098375
PCT Pub. Date: May 31, 2018

(65) Prior Publication Data
US 2020/0181224 A1    Jun. 11, 2020

Related U.S. Application Data

(60) Provisional application No. 62/425,237, filed on Nov. 22, 2016, provisional application No. 62/456,318, filed on Feb. 8, 2017.

(51) Int. Cl.
| | |
|---|---|
| *A61K 38/17* | (2006.01) |
| *A61K 38/47* | (2006.01) |
| *A61K 47/68* | (2017.01) |
| *A61P 13/12* | (2006.01) |
| *C07K 14/47* | (2006.01) |
| *C07K 14/705* | (2006.01) |
| *C12N 9/24* | (2006.01) |
| *A61K 38/00* | (2006.01) |

(52) U.S. Cl.
CPC ........ *C07K 14/705* (2013.01); *A61K 38/1709* (2013.01); *A61K 38/47* (2013.01); *A61K 47/6811* (2017.08); *A61K 47/6889* (2017.08); *A61P 13/12* (2018.01); *C07K 14/47* (2013.01); *C12N 9/2402* (2013.01); *A61K 38/00* (2013.01); *C07K 2317/52* (2013.01); *C07K 2319/30* (2013.01); *C07K 2319/31* (2013.01); *C07K 2319/50* (2013.01)

(58) Field of Classification Search
CPC ................ A61K 38/1709; A61K 38/47; A61K 47/6811; A61K 47/6815; A61K 47/6889; C07K 14/47; C07K 14/705; C07K 2319/30; C07K 2319/50; C12N 9/2402
See application file for complete search history.

(56) References Cited

U.S. PATENT DOCUMENTS

| | | |
|---|---|---|
| 2006/0248398 A1 | 11/2006 | Neel et al. |
| 2008/0070280 A1 | 3/2008 | Schilling et al. |
| 2008/0097244 A1 | 4/2008 | Arnitz |
| 2008/0138846 A1 | 6/2008 | Kubota et al. |
| 2009/0192087 A1 | 7/2009 | Glass et al. |
| 2011/0084452 A1 | 4/2011 | Yu |
| 2011/0195077 A1 | 8/2011 | Glass et al. |
| 2012/0178699 A1 | 7/2012 | Wolf et al. |
| 2013/0129724 A1 | 5/2013 | Novartis |
| 2020/0282032 A1* | 9/2020 | Jones .................. G01N 33/574 |

FOREIGN PATENT DOCUMENTS

| | | | |
|---|---|---|---|
| KR | 20170111384 A | * 10/2017 | |
| WO | 2000/27885 A1 | 5/2000 | |
| WO | 2011/084452 A1 | 7/2011 | |
| WO | 2012/018638 A2 | 2/2012 | |
| WO | 2016/088059 A1 | 6/2016 | |
| WO | WO-2016088059 A1 * | 6/2016 | ............. A61P 27/16 |

(Continued)

OTHER PUBLICATIONS

Genbank accession No. NM_004795, for *Homo sapiens* klotho (KL), mRNA, Oct. 28, 2018, accessed Aug. 31, 2021. (Year: 2018).*

(Continued)

*Primary Examiner* — Jeffrey E. Russel
(74) *Attorney, Agent, or Firm* — Workman Nydegger

(57) ABSTRACT

Recombinant Klotho proteins, nucleic acids encoding the same, cell lines and cultures expressing the same, and method of manufacturing and administering the same are disclosed. Proteins have at least 80% amino acid sequence identity to a portion of human alpha Klotho and preferably a solubility or half-life-extending feature such as glycosylation and/or fusion protein tag. Treatment protocols include determining Klotho levels in a subject, calculating a dosage of the protein sufficient to raise the Klotho level in the subject to a predetermined level, administering the dosage to the subject, determining a rate of protein decline in the subject following administration of the protein, calculating a time and/or amount of a subsequent dosage of the protein, and/or administering the subsequent dosage to the subject. Proteins and related treatments for addressing aging-associated and other conditions are disclosed.

20 Claims, 14 Drawing Sheets
Specification includes a Sequence Listing.

(56) References Cited

FOREIGN PATENT DOCUMENTS

| WO | 2016/135295 A1 | 9/2016 | |
|---|---|---|---|
| WO | WO-2017008016 A1 * | 1/2017 | ........... A61K 9/0019 |
| WO | 2017/210607 A1 | 12/2017 | |
| WO | 2018/098375 A1 | 5/2018 | |

OTHER PUBLICATIONS

Hu et al. Klotho as a potential biomarker and therapy for acute kidney injury. Jun. 5, 2012. Nature Reviews Nephrology, vol. 8, pp. 423-429. (Year: 2012).*
Hu et al. Klotho deficiency is an early biomarker of renal ischemia-reperfusion injury and its replacement is protective. 2010. Kidney International. vol. 78, pp. 1240-1251. (Year: 2010).*
Ravikumar et al. Alpha-Klotho protects against oxidative damage in pulmonary epithelia. The American Journal of Physiology-Lung Cellular and Molecular Physiology. 2014. vol. 307, pp. L566-L575. (Year: 2014).*
Levin et al. Fc fusion as a platform technology: potential for modulating immunogenicity. Trends in Biotechnology. Jan. 2015, vol. 33, No. 1, pp. 27-34. (Year: 2015).*
European Supplementary Partial Search Report and Search Opinion Received for EP Application No. 17875034.5, dated Jul. 1, 2020, 16 pages.
Invitation to Pay Additional Fees received for PCT Patent Application No. PCT/US2018/064333, dated May 30, 2019, 4 pages.
Krleza et al., Biochemia Medica 2015; 25(3): 335-58 (Year: 2015).
European Search Report dated Jan. 8, 2020, issued in European Application No. 17807601.4.
International Preliminary Report on Patentability received for PCT Patent Application No. PCT/US2018/064333, dated Jun. 18, 2020, 12 pages.
International Search Report and Written Opinion received for PCT Patent Application No. PCT/US2018/064333, dated Jul. 22, 2019, 16 pages.
Ming Chang Hu et al., Secreted Klotho and Chronic Kidney Disease, Advances in Experimental Medicine and Biology, 2012, vol. 728, pp. 126-157.
International Search Report and Written Opinion dated Mar. 27, 2018, issued in PCT Application No. PCT/US2017/063149, filed Nov. 22, 2017.
H. Sugiura et al., Klotho reduces apoptosis in experimental ischaemic acute kidney injury via HSP-70. Nephrology Dialysis Transplantation. Jan. 2010, Epub Sep. 10, 2009, vol. 25, No. 1; pp. 60-68; p. 60, 2nd col., 2nd paragraph; p. 67, 2nd col., 1st paragraph; DOI: 10.1093/ndt/gfp451.
MC Panesso et al., Klotho has dual protective effects on cisplatin-induced acute kidney injury. Kidney International. Apr. 2014, Epub Dec. 4, 2013, vol. 85, No. 4; pp. 855-870; p. 3, 4th paragraph; p. 7, 4th paragraph; DOI: 10.1038/ki.2013.489.
International Search Report dated Oct. 30, 2017, issued in PCT Application No. PCT/US2017/035755, filed Jun. 2, 2017.
International Preliminary Report on Patentability dated Dec. 13, 2018, issued in PCT Application No. PCT/US2017/035755, filed Jun. 2, 2017.
Biochemical and Biophysical Research Communications, 1998, 242, p. 626-630.
Partial EP Search Report dated Jul. 1, 2020, issued in EP Application No. 17875034.5.
Osamu Tohyama et al., *Klotho is a α-Glucuronidase Capable of Hydrolyzing Steroid α-Glucuronides*, The Journal of Biological Chemistry, vol. 279, No. 11, Mar. 12, 2004, pp. 9777-9784.
Yukiari Kato et al., *Establishment of the Anti-Klotho Monoclonal Antibodies and Detection of Klotho Protein in Kidneys*, Biochemical and Biophysical research Communication, vol. 267, 2000, XP002572556, pp. 597-602.
Yuji Yamazaki et al., *Establishment of Sandwich ELISA for Soluble Alpha-Klotho Measurement: Age-Dependent Change of Soluble Alpha-Klotho Levels in Healthy Subjects*, Biochemical and Biophysical research Communications, vol. 398, 2010, pp. 513-518.
Michelle Shardell et al: "Plasma Klotho and Frailty in Older Adults: Findngs From the InCHIANTI Study", Journals of Gerontology, Seris A, Biological Sciences Andmedical Sciences, vol. 00, Oct. 19, 2017 pp. 1-6.
Rotondi Silverio et al: "Soluble [alpha]-Klotho Serum Levels in Chronic Kidney Disease", International journla of Endocrinology, [Online] vol. 2015, Jan. 1, 2015 pp. 1-8.

* cited by examiner

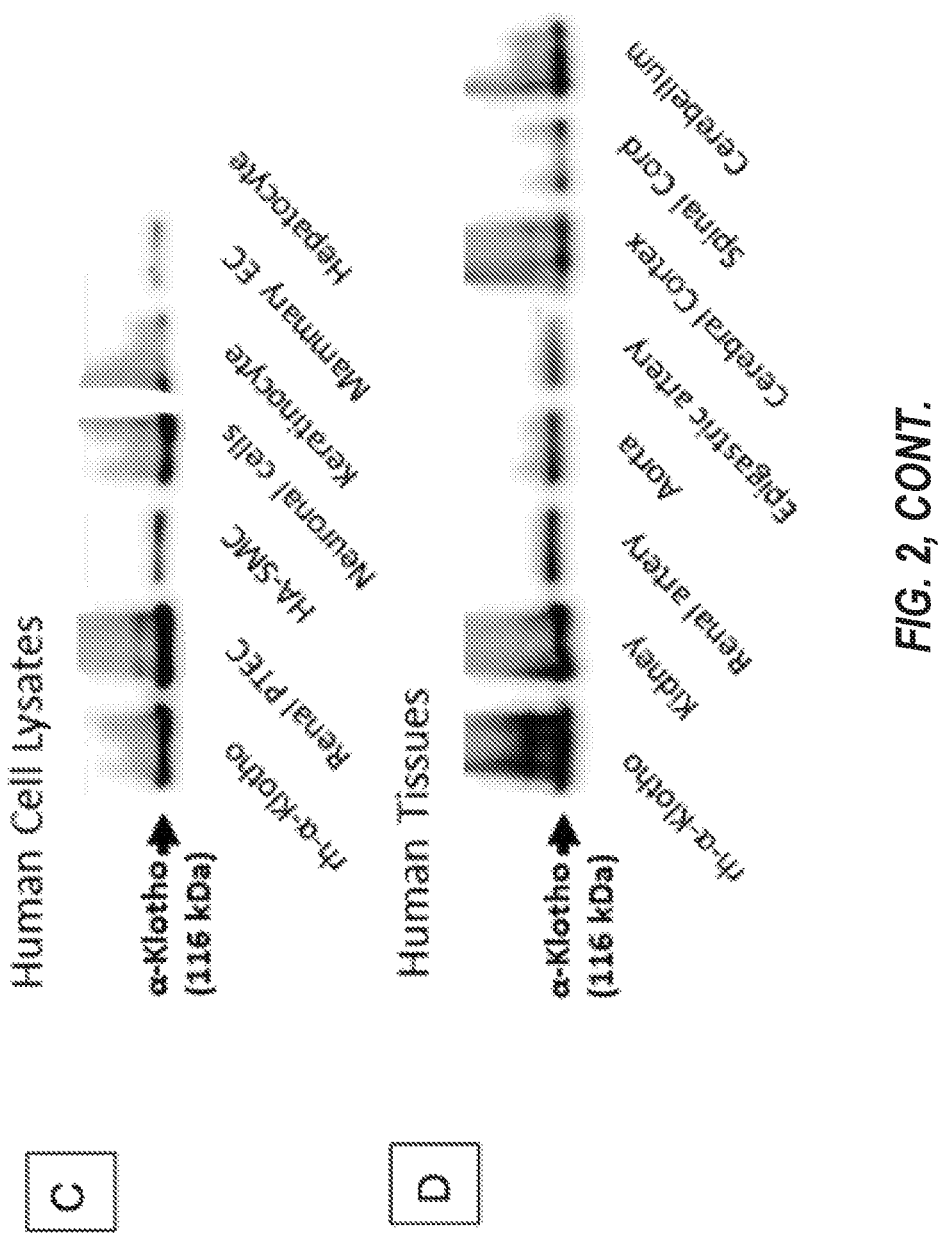
FIG. 2, CONT.

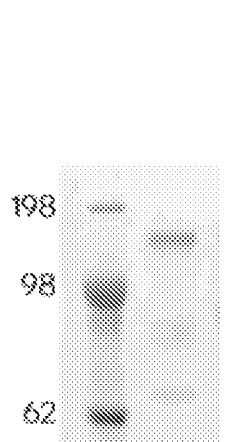
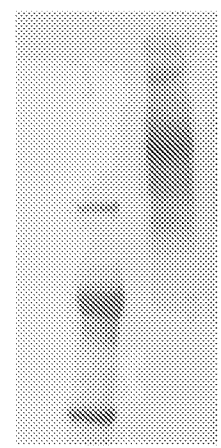
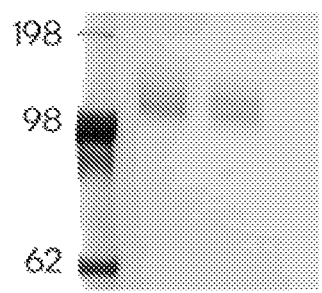
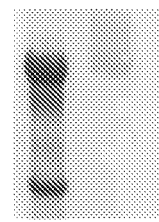
FIG. 4A   FIG. 4B   FIG. 5A   FIG. 5B
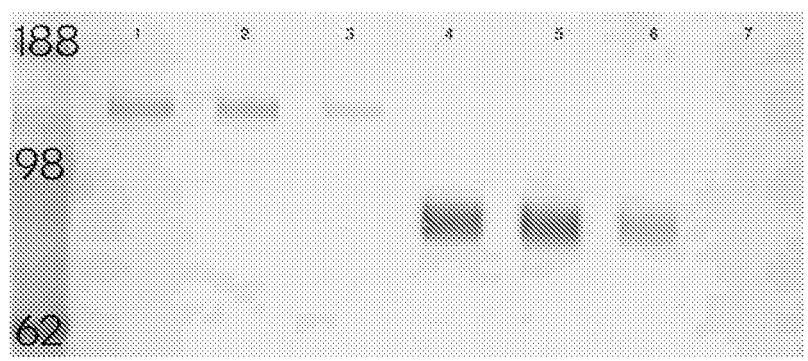
1 Native Klotho ECD (34-981)-nativeSS-Fc-CHO
2 Native Klotho ECD (34-981)-ATUMSS-Fc-CHO
3 Klotho ECD variant-1(36-981)-ATUMSS-Fc-CHO
4 Native secreted/isoform 2 (34-549)-nativeSS-Fc-CHO
5 Native secreted/isoform 2 (34-549)-ATUMSS-Fc-CHO
6 Secreted variant (36-549)-ATUMSS-Fc-CHO
7 Klotho ECD variant-2 (131-981)-ATUMSS-Fc-CHO
FIG. 6

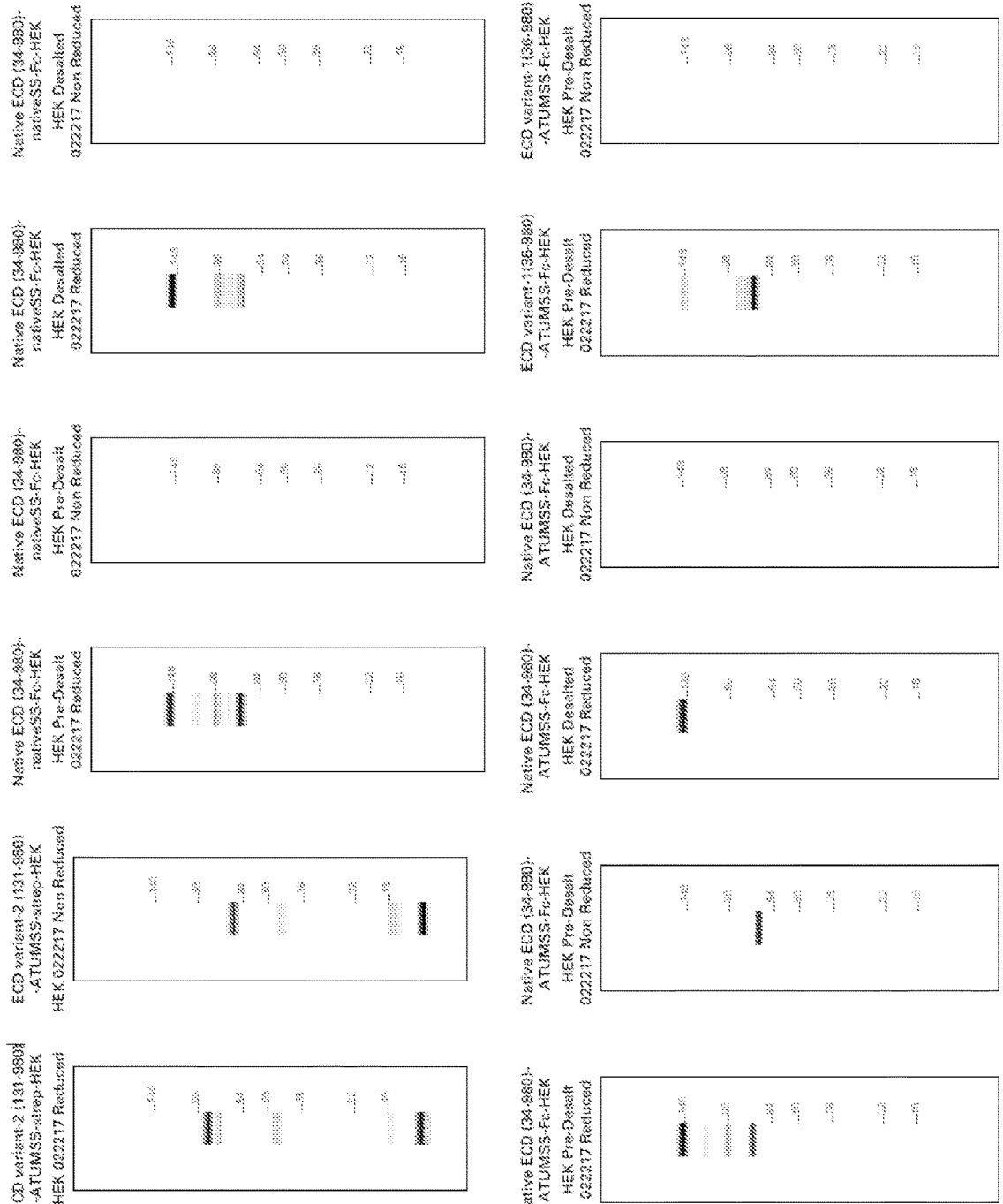
FIG. 7, cont.

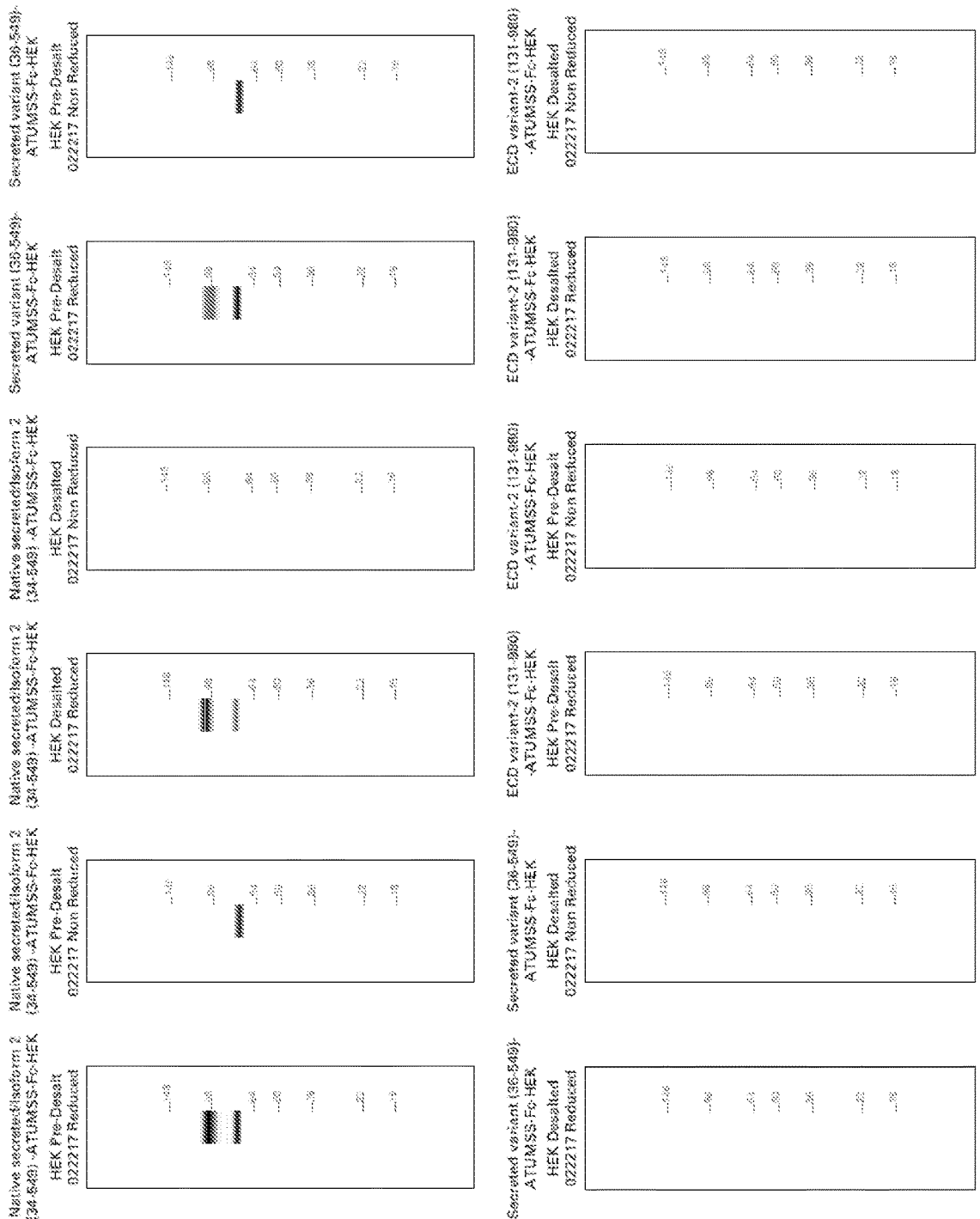
FIG. 7, cont.

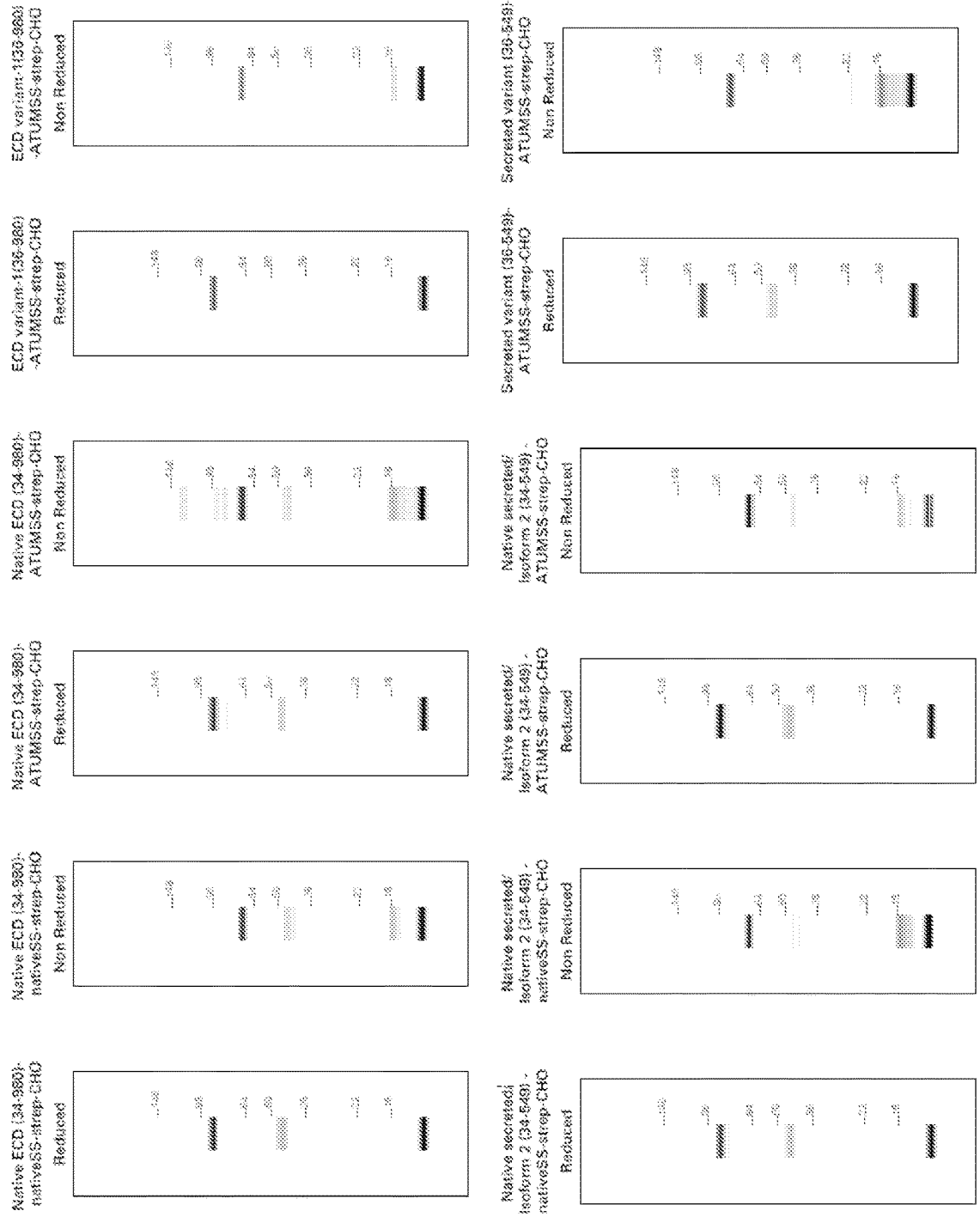
FIG. 7, cont.

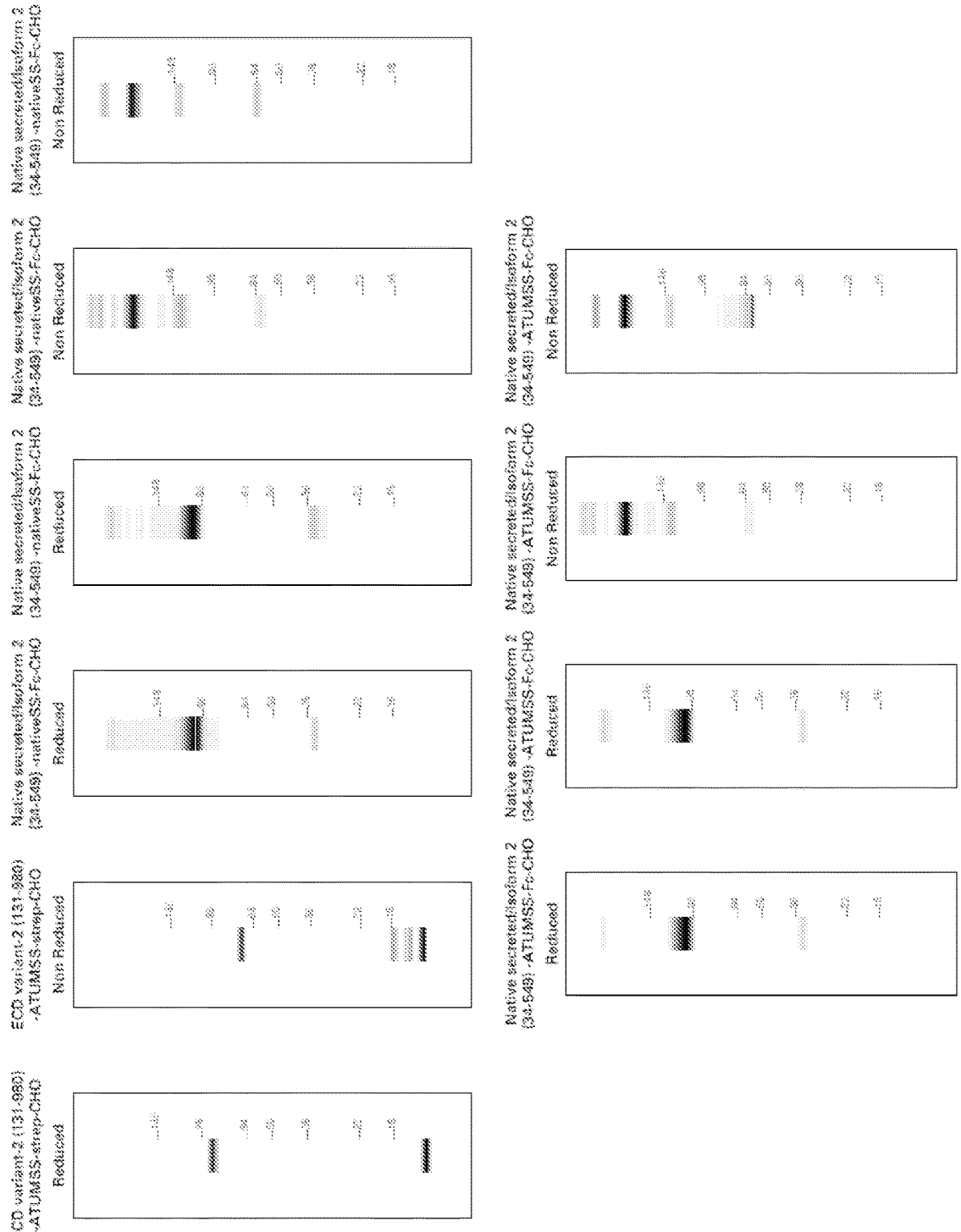
FIG. 7, cont.

RECOMBINANT KLOTHO PROTEINS AND COMPOSITIONS AND METHODS INVOLVING SAME

BACKGROUND

1. Technical Field

The present disclosure relates to the production and administration of recombinant human Klotho protein compositions as therapeutic agents. Specifically, the present disclosure relates to compositions that include a cGMP-grade human recombinant soluble alpha-Klotho protein or variant thereof, and methods of manufacturing and administering the same to human or non-human subjects.

2. Related Technology

Klotho (or alpha-Klotho, α-Klotho, etc.) is a recently characterized protein encoded by the KL (or klotho) gene, located on human chromosome 13. Two transcripts that arise from a single klotho gene through alternative RNA splicing have been identified. See FIGS. 1 and 2. The first transcript is predicted to encode Klotho isoform 1—a full-length, 1,012 amino acid, single-pass transmembrane-membrane protein, with a short cytoplasmic tail (human residues 1003-1012), a transmembrane (TM) domain (human residues 982-1002), and extracellular region or domain (human residues 1-981) comprising two homologous (internal repeat) domains (termed KL1 (human residues 56-506, which is 450 residues long) and KL2 (human residues 515-953, which is 438 residues long), which each share 20%-40% amino acid sequence homology to β-glucosidases, but may lack similar levels of glucosidase catalytic activity), and a signal sequence (SS) domain (human residues 1-33). The SS, KL1, and KL2 domain-containing extracellular region (human residues 1-981) may be enzymatically cleaved by a/β-secretases, and released into the circulatory stream as a 130 kDa circulating protein, termed soluble klotho (or sKlotho, s-Klotho, alpha soluble-Klotho, etc.). The extracellular region can also be cleaved into separate 68 kDa protein (KL1+SS) and 64 kDa protein (KL2).

The second transcript, a splicing variant of alpha-klotho mRNA, encodes a second isoform of Klotho protein corresponding mainly to the KL1 domain. The internal splice donor site is thought to be located in exon 3 of the klotho gene. The resultant alternatively spliced transcript contains a 50 bp insertion after exon 3 (FIG. 1; gray), with an in-frame translation stop codon at the end thereof. The expressed protein product is secreted into the circulation and is termed secreted Klotho (or Klotho isoform 2), which differs from the canonical sequence of isoform 1 at amino acid residues 535-549, and with amino acid residues 550-1012 missing.

Accordingly, there may be a number of different Klotho proteins in the circulation at any given time, depending on gene expression, RNA splicing, and enzymatic cleavage. Despite the existence of various forms of alpha-Klotho protein, only the full length, membrane-bound, isoform 1 is known to form a complex with fibroblast growth factor (FGF) receptors and functions as an obligatory co-receptor for FGF23—a bone-derived hormone that induces phosphate excretion into urine and which has a regulatory role on $P_i$ and vitamin D metabolism.

Klotho is highly expressed in the kidney, brain, and to a lesser extent in other organs, and may also be found in the cerebrospinal fluid and urine of mammals. Circulating levels of soluble Klotho proteins in mammals are thought to decrease with age. In addition, Klotho-deficient mice exhibit accelerated aging phenotypes, whereas over-expression of klotho in mice has been shown to extend lifespan. In addition, Klotho has been implicated in a number of cellular processes related to aging. In light of the foregoing, a developing hypothesis states that soluble Klotho may function as an anti-aging compound in the human body.

Aging is an inevitable and progressive biological process resulting in dysfunction and destruction of almost all tissues and organs, ultimately resulting in death. The aging of the human body, for instance, is associated with the decline of cellular function, which can lead to the development of a variety of diseases. Aging is thought to be driven by a tightly regulated and complex interplay between genetic and acquired factors and is typically characterized by an increase in senescence, a quantitative and qualitative decrease in stem cells, and abnormal structure at tissue levels.

As the so-called "baby boomers" generation continues to advance in age, the population of aging individuals (e.g., age 60-65) is rapidly increasing globally. The increased demand for health care for this aging population places significant financial burden on any healthcare system. Recombinant klotho proteins may provide promising therapeutic agents to counter age-related health conditions. Developing strategies and health intervention methods based on the production and purification (e.g., to substantial homogeneity) of soluble Klotho, and the administration of this protein to subjects within an increasing aging population, may help to ameliorate this situation and the problems associated therewith.

Currently, there is not a product or method for providing an exogenous form of human Klotho protein, such as recombinant soluble human alpha-Klotho protein or protein variant, especially protein that is Current Good Manufacturing Practice (cGMP) regulation compliant, as determined and enforced by the U.S. Food and Drug Administration (FDA), whether alone or in combination with one or more additional active components. To date, all relevant treatment data related to Klotho is pre-clinical, research trials in animal models. Developing strategies and health intervention methods based on the administration of recombinant S-Klotho to subjects, especially humans and/or within an increasing aging population may help to ameliorate this situation.

BRIEF SUMMARY

Embodiments of the present disclosure solve one or more of the foregoing or other problems in the art with recombinant human Klotho proteins, protein fragments, and/or protein variants, expression nucleic acid constructs and/or vectors, cell lines and/or cell suspension cultures, and methods of manufacturing, purifying, and administering the same to (human or non-human animal) subjects.

For example, some embodiments of the present disclosure can include one or more of: a recombinant human alpha soluble Klotho protein, protein fragment, and/or protein variant; a composition (e.g., therapeutic composition, pharmaceutical composition, medicament, formulation), etc. comprising a recombinant human alpha soluble Klotho protein; a composition comprising a recombinant human alpha soluble Klotho protein and a (pharmaceutically-acceptable) vehicle (e.g., a carrier or excipient); a composition comprising a recombinant human alpha soluble Klotho protein and at least one additional (active) ingredient; a nucleic acid construct or vector that encodes a recombinant human alpha soluble Klotho protein; a cell line that contains (i) a nucleic acid construct or vector that encodes a recombinant human alpha soluble Klotho protein and/or (ii) expresses a recombinant human alpha soluble Klotho protein; a cell suspension culture of cells that contain (i) a nucleic acid construct or vector that encodes a recombinant human alpha soluble Klotho protein and/or (ii) express a recombinant human alpha soluble Klotho protein; a method of manufacturing, and optionally purifying, a recombinant human alpha soluble Klotho protein; a method of manufacturing a medicament (or therapeutic composition—i.e., formulation) of recombinant human alpha soluble Klotho protein; a method of administering a recombinant human alpha soluble Klotho protein to a (human or non-human animal) subject; a diagnostic method for determining Klotho protein deficiency in a subject; a method of diagnosing Klotho protein deficiency in a subject; a method of diagnosing a subject as being in need of receiving a recombinant human alpha soluble Klotho protein by administration; a method for evaluating the efficacy and/or determining an effective dosage of the protein to a subject in need thereof; a recombinant human alpha soluble Klotho protein for use in treating a specific medical or other condition in a human or non-human animal (e.g., a non-human mammal); use of a recombinant human alpha soluble Klotho protein for the treatment of a specific medical or other condition in a human or non-human animal; use of a composition comprising a recombinant human alpha soluble Klotho protein for the treatment of a specific medical or other condition in a human or non-human animal; and/or use of a recombinant human alpha soluble Klotho protein in the manufacture of a medicament for the treatment of a specific medical or other condition in a human or non-human animal.

Some embodiments can include a method of manufacturing recombinant Klotho protein, the method comprising producing a recombinant Klotho protein in Chinese hamster ovary (CHO) cells, preferably in dihydrofolate reductase (DHFR)-deficient CHO cells, more preferably in CHO—S cells, or preferably in glutamine synthetase (GS)-deficient CHO cells, more preferably in GS –/– CHO cells, the protein preferably having at least 80% amino acid sequence identity to at least a portion of one of SEQ ID NO: 2 through SEQ ID NO: 70 or SEQ ID NO: 107 through SEQ ID NO: 120.

Some embodiments can include a cell line, comprising a plurality of Chinese hamster ovary (CHO) cells, preferably in dihydrofolate reductase (DHFR)-deficient CHO cells, more preferably in CHO—S cells, or preferably in glutamine synthetase (GS)-deficient CHO cells, more preferably in GS –/– CHO cells, the CHO cells containing an exogenous nucleic acid comprises a promoter, preferably a strong promoter, and encodes a polypeptide, at least a portion of the polypeptide having at least 80% amino acid sequence identity to at least a portion of one of SEQ ID NO: 2 through SEQ ID NO: 70 or SEQ ID NO: 107 through SEQ ID NO: 120, and optionally, a functional dihydrofolate reductase (DHFR) enzyme or a functional glutamine synthetase (GS) enzyme.

Some embodiments can include a suspension cell culture, comprising a liquid medium, preferably a serum-free and/or animal protein component-free liquid medium, wherein the liquid medium preferably comprises a carbon source, a nitrogen source, and one or more vitamins, minerals, salts, amino acids, supplements, or additives, more preferably wherein the liquid medium lacks hypoxanthine, thymidine, and/or glutamine, and the cell line of any one of claims 14-17 growing in the liquid medium such that the CHO cells express the polypeptide encoded by the nucleic acid, the polypeptide comprising a recombinant Klotho protein.

Some embodiments can include a recombinant Klotho protein, wherein at least a portion of the protein has at least 80% amino acid sequence identity to at least a portion of one of SEQ ID NO: 2 through SEQ ID NO: 70 or SEQ ID NO: 107 through SEQ ID NO: 120. Some embodiments can include recombinant protein comprising a Klotho protein sequence having at least 80% amino acid sequence identity to at least a portion of one of SEQ ID NO: 2 through SEQ ID NO: 70 or SEQ ID NO: 107 through SEQ ID NO: 120, preferably one of SEQ ID NO: 52, SEQ ID NO: 54, and SEQ ID NO: 66 and, optionally at least a portion of an immunoglobulin Fc domain sequence or a Twin-Strep tag sequence, with or without an optional linker sequence therebetween.

Some embodiments can include a pharmaceutical composition, comprising a pharmaceutically effective amount of the recombinant Klotho protein as described herein and a pharmaceutically-acceptable carrier. Some embodiments can include a pharmaceutical composition, comprising a pharmaceutically effective amount of a recombinant soluble Klotho protein, at least a portion of the protein having at least 80% amino acid sequence identity to at least a subset of amino acid residues 1-981, 29-981, 34-981, 36-981, 131-981, 1-549, 29-549, 34-549, 36-549, or 131-549 of human alpha Klotho isoform 1 or isoform 2, or at least a portion of one of SEQ ID NO: 2 through SEQ ID NO: 70 or SEQ ID NO: 107 through SEQ ID NO: 120, and a pharmaceutically-acceptable carrier. Some embodiments can include a pharmaceutical composition, comprising a pharmaceutically-acceptable carrier or excipient and an effective amount of a recombinant protein comprising a Klotho protein sequence having at least 80% amino acid sequence identity to at least a portion of one of SEQ ID NO: 2 through SEQ ID NO: 70 or SEQ ID NO: 107 through SEQ ID NO: 120, preferably one of SEQ ID NO: 52, SEQ ID NO: 54, and SEQ ID NO: 66 and, optionally at least a portion of an immunoglobulin Fc domain sequence or a Twin-Strep tag sequence, with or without an optional linker sequence therebetween.

Some embodiments can include a method of treating an aging-related or other condition, disease, or disorder, the method comprising administering to a subject in need thereof a pharmaceutically effective amount of the recombinant Klotho protein as described herein. Some embodiments can include a method of treating an aging-related or other condition, disease, or disorder, the method comprising administering to a subject in need thereof a pharmaceutically effective amount of a soluble recombinant Klotho protein having at least 80% amino acid sequence identity to at least a subset of amino acid residues 1-981 of human alpha Klotho isoform 1 or amino acid residues 1-549 of human alpha Klotho isoform 2. Some embodiments can include a method of treating an aging-related or other condition, disease, or disorder, the method comprising administering to a subject in need thereof a pharmaceutically effective amount of a soluble recombinant Klotho protein having at least 80% amino acid sequence identity to at least a portion of one of SEQ ID NO: 2 through SEQ ID NO: 70 or SEQ ID NO: 107 through SEQ ID NO: 120. Some embodiments can include a method of treating and/or preventing a condition, disease, or disorder, preferably a condition, disease, or disorder associated with aging, in a mammalian subject, the method comprising administering to the subject a pharmaceutical composition comprising a pharmaceutically-acceptable carrier or excipient and an effective amount of a recombinant protein comprising a Klotho protein sequence having at least 80% amino acid sequence identity to at least a portion of one of SEQ ID NO: 2 through SEQ ID NO: 70 or SEQ ID NO: 107 through SEQ ID NO: 120, preferably one of SEQ ID NO: 52, SEQ ID NO: 54, and SEQ ID NO: 66 and, optionally at least a portion of an immunoglobulin Fc domain sequence or a Twin-Strep tag sequence, with or without an optional linker sequence therebetween.

Some embodiments can include a method of treating or preventing acute kidney injury (AKI), chronic kidney disease (CKD), or other condition, the method comprising administering to a subject in need thereof a pharmaceutically effective amount of a recombinant Klotho protein, at least a portion of the protein having at least 80% amino acid sequence identity to at least a subset of amino acid residues 1-981, 29-981, 34-981, 36-981, 131-981, 1-549, 29-549, 34-549, 36-549, or 131-549 of human alpha Klotho isoform 1 or isoform 2, or at least a portion of one of SEQ ID NO: 2 through SEQ ID NO: 70 or SEQ ID NO: 107 through SEQ ID NO: 120. Some embodiments can include a method of treating and/or preventing kidney injury in a mammalian subject, the method comprising administering to the subject, optionally prophylactically, prior to a medical procedure or administration of a nephrotoxin and/or following a medical procedure or administration of a nephrotoxin, a pharmaceutical composition comprising a pharmaceutically-acceptable carrier or excipient and an effective amount of a recombinant protein comprising a Klotho protein sequence having at least 80% amino acid sequence identity to at least a portion of one of SEQ ID NO: 2 through SEQ ID NO: 70 or SEQ ID NO: 107 through SEQ ID NO: 120, preferably one of SEQ ID NO: 52, SEQ ID NO: 54, and SEQ ID NO: 66 and, optionally at least a portion of an immunoglobulin Fc domain sequence or a Twin-Strep tag sequence, with or without an optional linker sequence therebetween.

Some embodiments can include compositions that include a therapeutic Klotho protein, for example cGMP-grade human recombinant soluble alpha-Klotho protein, and at least one other active component, such as a drug, antibody, hormone, human cell, tissue, cellular or tissue-based product (HCT/Ps), etc., and/or methods of administering the same to human or non-human subjects. Combinatorial compositions and methods can be useful for treating subjects having an age-related disorder or condition, a metabolic disorder, a chronic disease, an acute injury, and so forth. The prophylactic administration of combination treatments to subjects with no apparent condition or disorder can also be useful in to delay or prevent certain conditions or disorders described herein.

Some embodiments can include a nucleic acid or nucleic acid construct. For instance, embodiments can include an expression vector or nucleic acid. The nucleic acid can encode a recombinant human alpha soluble Klotho protein, protein fragment, or protein variant. The nucleic acid can encode a native or non-native signaling sequence. For instance, the nucleic acid can encode a non-native signaling sequence upstream (or N-terminal to) an encoded Klotho protein sequence. Some embodiments can include a nucleic acid construct, comprising a nucleic acid sequence encoding a recombinant protein, the recombinant protein comprising a Klotho protein sequence having at least 80% amino acid sequence identity to at least a portion of one of SEQ ID NO: 2 through SEQ ID NO: 70 or SEQ ID NO: 107 through SEQ ID NO: 120, preferably one of SEQ ID NO: 52, SEQ ID NO: 54, and SEQ ID NO: 66; and, optionally at least a portion of an immunoglobulin Fc domain sequence or a Twin-Strep tag sequence, with or without an optional linker sequence therebetween.

Some embodiments can include a method of manufacturing a recombinant human alpha soluble Klotho protein. The manufacturing method can include growing Chinese hamster ovary (CHO) cells in a liquid medium, producing the recombinant soluble Klotho protein in the CHO cells, and/or purifying a recombinant soluble Klotho protein-containing extract from the CHO cells, liquid medium, or both. The extract can include at least about 90%, preferably at least about 92%, 93%, 94%, 95%, 96%, 97%, 98%, or 99% dry weight recombinant soluble Klotho protein and/or less than about 1-100 ppm CHO host cell proteins (HCP). The CHO cells can be dihydrofolate reductase (DHFR)-deficient CHO cells, such as CHO—S cells, or glutamine synthetase (GS)-deficient CHO cells, such as GS –/– CHO cells. The produced (expressed) protein can be released (e.g., secreted) from the CHO cells into the liquid medium and/or can have one or more glycans attached thereto.

The CHO cells can contain one or more exogenous nucleic acids that encode the protein and, optionally, a functional enzyme, such as dihydrofolate reductase enzyme, glutamine synthetase (GS) enzyme, etc. The exogenous nucleic acid can include a promoter (e.g., a strong promoter, weak promoter, etc.), such as a promoter customary or typical for use for expression of exogenous protein in CHO cell. The exogenous nucleic acid can include a transgene or cDNA (e.g., under control of the promoter), preferably having at least 80% nucleic acid sequence identity to one of SEQ ID NO: 76 through SEQ ID NO: 106 or SEQ ID NO: 121 through SEQ ID NO: 124, or any other suitable nucleic acid sequence encoding a Klotho protein as described herein (e.g., S-Klotho variants).

The method can include introducing, such as by transfection, the exogenous nucleic acid into the CHO cells. The method can include growing the CHO cells in a liquid medium, such as a (human, bovine, fetal bovine, or other) serum-free and/or animal (or animal-derived) protein (component)-free medium. The medium preferably comprises a carbon source, a nitrogen source, and/or one or more vitamins, minerals, salts, amino acids, supplements, or additives, preferably in a bioreactor. Depending on the particular CHO cell line, the method can include introducing an effective amount of methotrexate (MTX), methionine sulphoximine (MSX), or other agent into the liquid medium and/or selecting (e.g., by CHO cell sub-cloning, limited dilution, fluorescence activated cell sorting (FACS), etc.) a suspension culture of viable CHO cells growing in the liquid medium.

In some embodiments, selection and/or gene amplification can be performed by culturing the transfected cells in a selection medium, such as a medium lacking hypoxanthine and/or thymidine (e.g., —HT medium), glutamine, etc. In at least one embodiment, a low concentration(s) of MTX can be added or used to amplify the transfected nucleic acid (or gene(s) thereof) and, thereby, select for increased protein expression (e.g., in DHFR-deficient CHO cells transfected with a DHFR transgene). Alternatively (or in addition), selection and/or gene amplification can be performed by adding MSX (an inhibitor of (endogenous) glutamine synthetase (GS)) to suspension cultures of CHO cells having at least one (exogenous) glutamine synthetase (GS) transgene.

The method can include sub-culturing surviving cells or cultures (e.g., MTX-resistant and/or MSX-resistant cells or cultures). The selected suspension culture and/or selected CHO cells can have or exhibit an increased production of the protein (e.g., by the CHO cell), an increased concentration of the protein (e.g., in the liquid medium), and/or an increased copy number of the exogenous nucleic acid (e.g., per cell) (e.g., as compared to a non-selected suspension culture or CHO cell).

Certain embodiments can include a cell line comprising a plurality of CHO cells. For instance, the CHO cells can be DHFR-deficient CHO cells, such as CHO—S cells. The CHO cells can contain one or more (copies of an) exogenous nucleic acid (comprising a transgene or cDNA) that encodes a polypeptide with at least 80% amino acid sequence identity to at least a portion of one of SEQ ID NO: 2 through SEQ ID NO: 70 or SEQ ID NO: 107 through SEQ ID NO: 120. The polypeptide can comprise a human recombinant alpha soluble Klotho protein. The exogenous nucleic acid can include a transgene or cDNA, preferably having at least 80% nucleic acid sequence identity to one of SEQ ID NO: 76 through SEQ ID NO: 106 or SEQ ID NO: 121 through SEQ ID NO: 124. In some embodiments, the nucleic acid can (also) include or encode a promoter (associated with the transgene) and/or an optional (exogenous) enzyme, such as a (functional) dihydrofolate reductase (DHFR) enzyme, glutamine synthetase (GS) enzyme, etc.

At least one embodiment includes a suspension cell culture comprising the cell line growing in a liquid medium, preferably comprising a carbon source, a nitrogen source, and/or one or more vitamins, minerals, salts, amino acids, supplements, or additives, such that the CHO cells express the polypeptide encoded by the nucleic acid. The liquid medium can be (human, bovine, fetal bovine, or other) serum-free and/or animal (or animal-derived) protein (component)-free. For instance, the liquid medium can be free of bovine serum albumin, human serum albumin, etc.

The liquid medium can also include an effective amount of MTX and/or MSX in some embodiments. The suspension culture (or CHO cells thereof) can (be selected to): exhibit an increased production of the protein (e.g., by the CHO cells); exhibit an increased concentration of the protein (e.g., in the liquid medium); secrete the protein (e.g., into the liquid medium); and/or have an increased copy number of the exogenous nucleic acid (e.g., per cell), preferably as compared to a non-selected suspension culture. The protein can have one or more glycans attached thereto.

Some embodiments include an extract of or from the CHO cells, the liquid medium, or both of the suspension cell culture, the extract containing a recombinant protein having at least 80% amino acid sequence identity to at least a portion of one of SEQ ID NO: 2 through SEQ ID NO: 70 or SEQ ID NO: 107 through SEQ ID NO: 120. Certain embodiments include a human recombinant alpha soluble Klotho protein-containing extract of or from CHO cells, liquid medium, or both (e.g., of the suspension cell culture). At least one embodiment includes an isolated recombinant protein having at least 80% amino acid sequence identity to at least a portion of one of SEQ ID NO: 2 through SEQ ID NO: 70 or SEQ ID NO: 107 through SEQ ID NO: 120.

Some embodiments can include a method of administering a recombinant human alpha soluble Klotho protein to a human or non-human animal subject in need thereof. The subject to whom the Klotho protein is administered can be suffering from or at risk for a variety of conditions (e.g., disorders, diseases, injuries, illnesses, etc.). For example, some embodiments include a method of treating one or more chronic diseases and/or aging-related condition, such as a physical, mental, neurological, or other condition associated with (human) aging. Some embodiments can promote healing, recovery, longevity, and/or other beneficial outcome through one or more mechanisms or action. Embodiments can include, for example, administering to a subject in need thereof (e.g., a subject having or at risk of developing a condition) a pharmaceutically effective amount of a recombinant soluble Klotho protein or protein variant. Administration of such protein or protein variant can have a positive therapeutic effect on the course and outcome of the condition, including chronic and/or age-related disease and longevity in human subjects, and characterization of the same.

The pharmaceutically effective amount can be sufficient to raise the serum soluble Klotho protein concentration of the subject to a predetermined level, such as greater than, equal to, or between about 50 to 3000 picograms of soluble Klotho protein per milliliter of serum. The amount can also or alternatively be sufficient to maintain the serum soluble Klotho protein concentration of the subject at or above a predetermined threshold for a predetermined period of time. Embodiments can also include administering the protein to a subject in need thereof so as to maintain the serum soluble Klotho protein concentration of the subject at or above a predetermined threshold for a predetermined period of time.

Embodiments can also include determining a serum soluble Klotho protein concentration of the subject, calculating the pharmaceutically effective amount, determining a rate of soluble Klotho protein decline in the serum of the subject, calculating a subsequent dosage time at which the serum soluble Klotho protein concentration of the subject will be at or below a second predetermined level based on the determined rate, calculating a subsequent dosage amount of the protein sufficient to raise the serum soluble Klotho protein concentration of the subject from the second predetermined level to the first predetermined level, and/or administering the subsequent dosage amount of the protein to the subject.

The protein can (be effective to) modulate the IGF-1 and/or Wnt signaling pathways, exhibit β-glucuronidase and/or sialidase activity, suppress the p53/p21 signaling pathway, and/or reduce $H_2O_2$-induced cell senescence and apoptosis, preferably through suppression of the p53/p21 signaling pathway. The protein can function or be functional as a humoral factor, preferably exhibiting pleiotropic activity and/or preferably in the regulation of oxidative stress, growth factor signaling, ion homeostasis, and/or regulation of activity of glycoproteins on the cell surface, such as one or more ion channel proteins and/or growth factor receptors, such as Insulin/Insulin-Like Growth Factor-1 receptor.

The protein can also be effective to treat one or more aging-related condition (or condition associated with (human) aging), such as frailty, bone density loss or bone mineral density loss, weight loss, muscular atrophy or degeneration, decline in muscle mass, decline in muscle strength, hand strength, leg strength, or physical fitness, decline in movement, freedom of movement, quality of life assessment, ejection fraction, or exercise capacity, decline in learning, learning capacity, memory, or intellectual quotient, cognitive deterioration or forgetfulness, decline in cognitive capacity or function, decline in synaptic plasticity or synaptic function, and cellular senescence.

The protein can also be effective to treat one or more aging-related condition (or condition associated with (human) aging), such as Alzheimer's disease, Parkinson's disease, dementia or vascular dementia, amyotrophic lateral sclerosis (ALS) or motor neuron disease (MND), atrial fibrillation, chronic obstructive pulmonary disease (COPD), fibromyalgia, adult onset diabetes, arthritis or rheumatoid arthritis, osteoarthritis, osteoporosis, glaucoma, cataracts, macular degeneration and other eye diseases/disorders, multiple sclerosis (MS), lupus, and/or ulcerative colitis.

Accordingly, embodiments can also include a composition for use in treating one or more aging-related or other conditions. The composition can include a recombinant soluble Klotho protein (e.g., having at least 80% amino acid sequence identity to at least a portion of one of SEQ ID NO: 2 through SEQ ID NO: 70 or SEQ ID NO: 107 through SEQ ID NO: 120) and a pharmaceutically-acceptable carrier.

Some embodiments can include compositions that include a therapeutic Klotho protein, for example cGMP-grade human recombinant soluble alpha-Klotho protein, and at least one other active component, such as a drug, antibody, hormone, hormone, human cell, tissue, cellular or tissue-based product (HCT/Ps), etc., and methods of administering the same to human or non-human subjects. Combinatorial compositions and methods can be useful for treating subjects having an age-related disorder or condition, a metabolic disorder, a chronic disease, an acute injury, and so forth. The prophylactic administration of combination treatments to subjects with no apparent condition or disorder can also be useful in to delay or prevent certain conditions or disorders described herein.

In various embodiments of the present disclosure, whether products or processes, the recombinant Klotho protein can include one of the Klotho protein having a sequences with 80%-100% sequence identity to one of SEQ ID NO: 1 through SEQ ID NO: 38, preferably having a C-terminal tag with 80%-100% sequence identity to at least a portion of the sequences of SEQ ID NO: 74, optionally with the linker sequence having 80%-100% sequence identity to SEQ ID NO: 73 disposed therebetween, or a C-terminal tag with 80%-100% sequence identity to one of the sequences of SEQ ID NO: 75, SEQ ID NO: 102, SEQ ID NO: 103, or SEQ ID NO: 104, optionally with the linker or protease recognition sequence, preferably having 80%-100% sequence identity to SEQ ID NO: 105 or SEQ ID NO: 106, disposed therebetween. The protein can optionally include, or be expressed with a signaling sequence having 80%-100% sequence identity to SEQ ID NO: 71 or SEQ ID NO: 72. Preferably, the (manufactured, produced, expressed or administered) protein has 80%-100% sequence identity to one of SEQ ID NO: 39 through SEQ ID NO: 70, more preferably one of SEQ ID NO: 52, one of SEQ ID NO: 54, or one of SEQ ID NO: 66.

An exemplary method of manufacturing recombinant Klotho protein comprises: producing a recombinant Klotho protein in Chinese hamster ovary (CHO) cells, preferably in dihydrofolate reductase (DHFR)-deficient CHO cells, more preferably in CHO—S cells, or preferably in glutamine synthetase (GS)-deficient CHO cells, more preferably in GS –/– CHO cells, the protein preferably having at least 80% amino acid sequence identity to at least a portion of one of SEQ ID NO: 2 through SEQ ID NO: 70 or SEQ ID NO: 107 through SEQ ID NO: 120.

An exemplary cell line comprises: a plurality of Chinese hamster ovary (CHO) cells, preferably in dihydrofolate reductase (DHFR)-deficient CHO cells, more preferably in CHO—S cells, or preferably in glutamine synthetase (GS)-deficient CHO cells, more preferably in GS –/– CHO cells, the CHO cells containing an exogenous nucleic acid comprises a promoter, preferably a strong promoter, and encodes: a polypeptide, at least a portion of the polypeptide having at least 80% amino acid sequence identity to at least a portion of one of SEQ ID NO: 2 through SEQ ID NO: 70 or SEQ ID NO: 107 through SEQ ID NO: 120; and optionally, a functional dihydrofolate reductase (DHFR) enzyme or a functional glutamine synthetase (GS) enzyme.

An exemplary suspension cell culture comprises: a liquid medium, preferably a serum-free and/or animal protein component-free liquid medium, wherein the liquid medium preferably comprises a carbon source, a nitrogen source, and one or more vitamins, minerals, salts, amino acids, supplements, or additives, more preferably wherein the liquid medium lacks hypoxanthine, thymidine, and/or glutamine; and the cell line of any one of claims 14-17 growing in the liquid medium such that the CHO cells express the polypeptide encoded by the nucleic acid, the polypeptide comprising a recombinant Klotho protein.

An exemplary recombinant Klotho protein includes at least 80% amino acid sequence identity to at least a portion of one of SEQ ID NO: 2 through SEQ ID NO: 70 or SEQ ID NO: 107 through SEQ ID NO: 120.

An exemplary method of treating an aging-related or other condition, disease, or disorder, the method comprising administering to a subject in need thereof a pharmaceutically effective amount of a soluble recombinant Klotho protein having at least 80% amino acid sequence identity to at least a subset of amino acid residues 1-981 of human alpha Klotho isoform 1.

An exemplary method of treating an aging-related or other condition, disease, or disorder, the method comprising administering to a subject in need thereof a pharmaceutically effective amount of a soluble recombinant Klotho protein having at least 80% amino acid sequence identity to at least a portion of one of SEQ ID NO: 2 through SEQ ID NO: 70 or SEQ ID NO: 107 through SEQ ID NO: 120.

An exemplary pharmaceutical composition comprises: a pharmaceutically effective amount of a recombinant soluble Klotho protein, at least a portion of the protein having at least 80% amino acid sequence identity to: at least a subset of amino acid residues 1-981, 29-981, 34-981, 36-981, 131-981, 1-549, 29-549, 34-549, 36-549, or 131-549 of human alpha Klotho isoform 1 or 2; or at least a portion of one of SEQ ID NO: 2 through SEQ ID NO: 70 or SEQ ID NO: 107 through SEQ ID NO: 120; and a pharmaceutically-acceptable carrier.

An exemplary method of treating or preventing acute kidney injury (AKI), chronic kidney disease (CKD), or other condition comprises: administering to a subject in need thereof a pharmaceutically effective amount of a recombinant Klotho protein, at least a portion of the protein having at least 80% amino acid sequence identity to: at least a subset of amino acid residues 1-981, 29-981, 34-981, 36-981, 131-981, 1-549, 29-549, 34-549, 36-549, or 131-549 of human alpha Klotho isoform 1 or 2; or at least a portion of one of SEQ ID NO: 2 through SEQ ID NO: 70 or SEQ ID NO: 107 through SEQ ID NO: 120.

An exemplary method of treating an aging individual, the aging individual having an (adverse) homozygous or heterozygous mutation in a gene encoding Klotho protein or no (adverse) mutation. The method comprises administering a therapeutic concentration of a polypeptide having at least 80% amino acid sequence identity to at least a portion of one of SEQ ID NO: 2 through SEQ ID NO: 70 or SEQ ID NO: 107 through SEQ ID NO: 120.

Some embodiments of the present disclosure can be useful in one or more of treating cancer, lowering serum phosphate levels in a patient, treating diabetes or a diabetes-related condition (e.g., Type 1 diabetes mellitus, etc.) in a subject in need of such treatment, treating a heart condition (e.g., cardiovascular disease, left ventricular hypertrophy (LVH), pathological LVH and/or congestive heart failure, etc.) in a subject, treating acute lung injury in a subject (e.g., using nanoparticles), protecting the lung of a patient against oxidant injury, detecting early acute kidney injury in critically ill patients, attenuating vascular calcification in a subject, improving cognition, treating renal and/or liver ischemia, modulating stress response in (human) senescent endothelial cells, prophylactically and/or therapeutically treating, preventing, attenuating, arresting, and/or reversing acute and/or chronic kidney injury, disease, or disease progression and/or uremic cardiomyopathy, reversing or attenuating age-related therapy resistance in Melanoma, targeting apoptosis of senescent cells, preferably restoring tissue homeostasis thereby, and a variety of other indications.

Some embodiments may include any of the features, options, and/or possibilities set out elsewhere in the present disclosure, including in other aspects or embodiments of the present disclosure. It is also noted that each of the foregoing, following, and/or other features described herein represent a distinct embodiment of the present disclosure. Moreover, combinations of any two or more of such features represent distinct embodiments of the present disclosure. Such features or embodiments can also be combined in any suitable combination and/or order without departing from the scope of this disclosure. Thus, each of the features described herein can be combinable with any one or more other features described herein in any suitable combination and/or order. Accordingly, the present disclosure is not limited to the specific combinations of exemplary embodiments described in detail herein.

Additional features and advantages of exemplary embodiments of the present disclosure will be set forth in the description that follows, and in part will be obvious from the description, or may be learned by the practice of such exemplary embodiments. The features and advantages of such embodiments may be realized and obtained by means of the instruments and combinations particularly pointed out in the appended claims. These and other features will become more fully apparent from the following description and appended claims, or may be learned by the practice of such exemplary embodiments as set forth hereinafter.

BRIEF DESCRIPTION OF THE DRAWINGS

In order to describe the manner in which the above-recited and other advantages and features of the present disclosure can be obtained, a more particular description of the embodiments briefly described above will be rendered by reference to specific embodiments thereof which are illustrated in the appended drawings. For better understanding, the like elements have been designated by like reference numbers throughout the figure(s). Understanding that these drawings depict only typical embodiments of the disclosure and are not therefore to be considered to be limiting of its scope, the disclosure will be described and explained with additional specificity and detail through the use of the accompanying drawing(s) in which:

FIG. 4A is a reduced, denatured Western blot analysis of full length extracellular domain-Fc fusion protein of SEQ ID NO: 52;

FIG. 4B is a non-reduced, denatured Western blot analysis of full length extracellular domain-Fc fusion protein of SEQ ID NO: 52;

FIG. 5A is a reduced, denatured Western blot of the full length extracellular domain-Twin-Strep tagged and subsequently cleaved protein of SEQ ID NO: 66

FIG. 5B is a non-reduced, denatured Western blot of the full length extracellular domain-Twin-Strep tagged protein of SEQ ID NO: 66;

FIG. 6 is a gel of the various indicated recombinant Klotho protein constructs;

DETAILED DESCRIPTION

Figure 1:
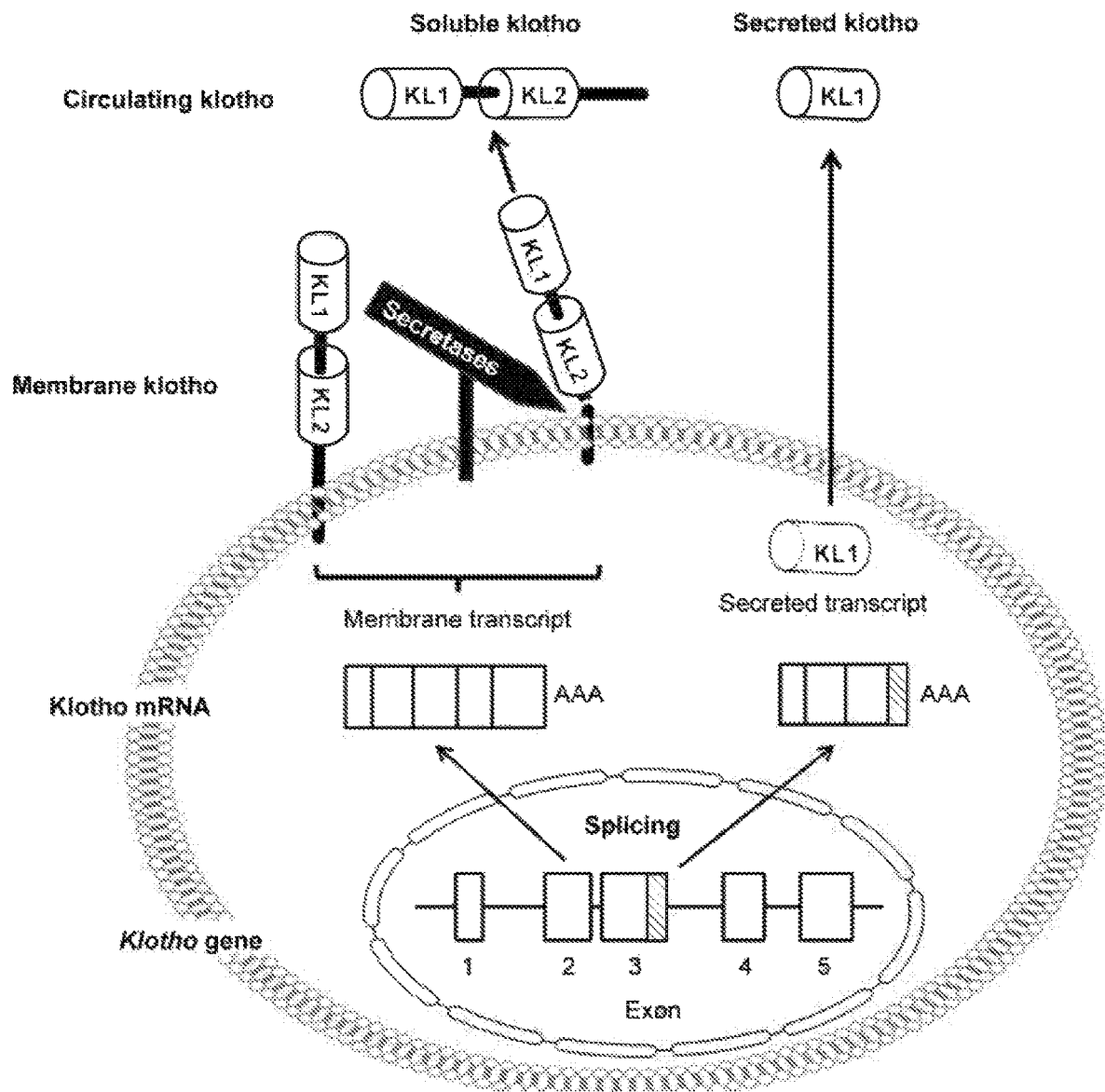
FIG. 1 depicts a schematic illustrating cellular production of various Klotho proteins according to an embodiment of the present disclosure.
Figure 2:
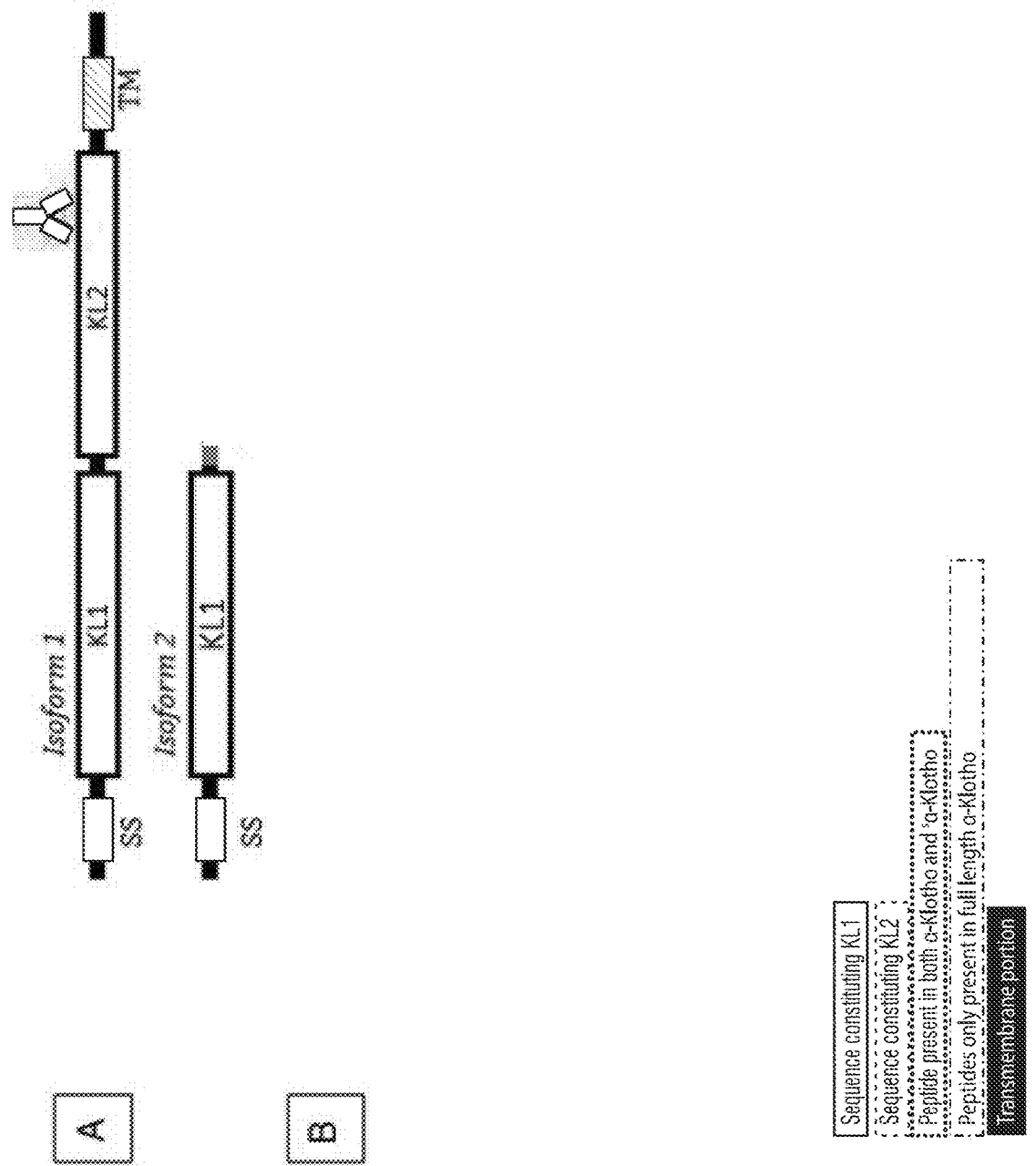
FIG. 2(A-D) depicts: A) schematic structures of isoform 1 and isoform 2 of human α-Klotho, and the location of the epitope for the antibody binding used in generating C-D (residues 800 to 900); B) The full-length α-Klotho protein sequence of 1012 amino acids, with KL1 and KL2 shown, respectively, and TM highlighted; C) and D) Western blot analysis of human cell lysates (C) and human tissues (D)

Before describing various embodiments of the present disclosure in detail, it is to be understood that this disclosure is not limited only to the specific parameters, verbiage, and description of the particularly exemplified systems, methods, and/or products that may vary from one embodiment to the next. Thus, while certain embodiments of the present disclosure will be described in detail, with reference to specific features (e.g., configurations, parameters, properties, steps, components, ingredients, members, elements, parts, and/or portions, etc.), the descriptions are illustrative and are not to be construed as limiting the scope of the present disclosure and/or the claimed invention. In addition, the terminology used herein is for the purpose of describing the embodiments, and is not necessarily intended to limit the scope of the present disclosure and/or the claimed invention.

Unless defined otherwise, all technical and scientific terms used herein have the same meaning as commonly understood by one of ordinary skill in the art to which the present disclosure pertains.

Various aspects of the present disclosure, including systems, methods, and/or products may be illustrated with reference to one or more embodiments, which are exemplary in nature. As used herein, the terms "embodiment" mean "serving as an example, instance, or illustration," and should not necessarily be construed as preferred or advantageous over other aspects disclosed herein. In addition, reference to an "embodiment" of the present disclosure or invention is intended to provide an illustrative example without limiting the scope of the invention, which is indicated by the appended claims.

As used in this specification and the appended claims, the singular forms "a," "an" and "the" each contemplate, include, and specifically disclose both the singular and plural referents, unless the context clearly dictates otherwise. For example, reference to a "protein" contemplates and specifically discloses one, as well as a plurality of (e.g., two or more, three or more, etc.) proteins. Similarly, use of a plural referent does not necessarily require a plurality of such referents, but contemplates, includes, specifically discloses, and/or provides support for a single, as well as a plurality of such referents, unless the context clearly dictates otherwise.

As used throughout this disclosure, the words "can" and "may" are used in a permissive sense (i.e., meaning having the potential to), rather than the mandatory sense (i.e., meaning must). Additionally, the terms "including," "having," "involving," "containing," "characterized by," variants thereof (e.g., "includes," "has," and "involves," "contains," etc.), and similar terms as used herein, including the claims, shall be inclusive and/or open-ended, shall have the same meaning as the word "comprising" and variants thereof (e.g., "comprise" and "comprises"), and do not exclude additional, un-recited elements or method steps, illustratively.

For the sake of brevity, the present disclosure may recite a list or range of numerical values. It will be appreciated, however, that where such a list or range of numerical values (e.g., greater than, less than, up to, at least, and/or about a certain value, and/or between two recited values) is disclosed or recited, any specific value or range of values falling within the disclosed values or list or range of values is likewise specifically disclosed and contemplated herein. By way of illustrative example, disclosure of "at least 80% amino acid sequence identity" or "80%-100% amino acid sequence identity" includes a specific disclosure of: (i) any whole percentage value between 80% and 100%, including 81%, 82%, 83%, 84%, 85%, 86%, 87%, 88%, 89%, 90%, 91%, 92%, 93%, 94%, 95%, 96%, 97%, 98%, 99%, and 100%, as well as any fraction of a percent value therebetween; and/or (ii) any range of percentage values between 80% and 100%, including, by way of non-limiting example, 81%-100%, 82%-100%, 83%-100%, 84%-100%, 85%-100%, 86%-100%, 87%-100%, 88%-100%, 89%-100%, 90%-100%, 91%-100%, 92%-100%, 93%-100%, 94%-100%, 95%-100%, 96%-100%, 97%-100%, 98%-100%, and 99%-100%.

To facilitate understanding, like references (i.e., like naming of components and/or elements) have been used, where possible, to designate like elements common to different embodiments of the present disclosure. Similarly, like components, or components with like functions, will be provided with similar reference designations, where possible. Specific language will be used herein to describe the exemplary embodiments. Nevertheless it will be understood that no limitation of the scope of the disclosure is thereby intended. Rather, it is to be understood that the language used to describe the exemplary embodiments is illustrative only and is not to be construed as limiting the scope of the disclosure (unless such language is expressly described herein as essential).

While the detailed description is separated into sections, the section headers and contents within each section are for organizational purposes only and are not intended to be self-contained descriptions and embodiments or to limit the scope of the description or the claims. Rather, the contents of each section within the detailed description are intended to be read and understood as a collective whole, where elements of one section may pertain to and/or inform other sections. Accordingly, embodiments specifically disclosed within one section may also relate to and/or serve as additional and/or alternative embodiments in another section having the same and/or similar products, methods, and/or terminology.

Embodiments of the present disclosure include products, compositions, and/or methods of manufacturing and/or using recombinant human Klotho proteins, such as (Current Good Manufacturing Practice (cGMP)-grade) human recombinant soluble alpha-Klotho proteins, protein fragments, and/or protein variants.

Gene therapy can be effective in animal studies. However, the safety of gene therapy, especially for human treatment, is still questionable. Compared to viral delivery of the klotho gene to animal (cells), the administration of exogenous and/or recombinant Klotho protein in humans may be a safer, easier, and more direct modality to restore (endocrine) klotho levels. Thus, similar to administering erythropoietin or erythropoiesis-stimulating agents to correct anemia in CKD patients and/or insulin to maintain normal glucose metabolism in type I diabetics, the administration of exogenous (human recombinant alpha soluble) Klotho protein, may be a viable and effective option in the near future to treat aging and/or aging-related disorders. For instance, the administration of exogenous (human recombinant alpha soluble) Klotho protein to humans may be an effective strategy to reverse or retard stem cell depletion and/or abate age-associated frailty or other pathology or pathological processes.

Preclinical data supports the therapeutic potential of soluble Klotho protein for age-related disorders and klotho deficiency-associated diseases. Epidemiological data has shown that soluble Klotho is lower in the elderly than in young adults, and that levels of soluble Klotho are inversely correlated with age, indicating that aging may be associated with soluble Klotho decline.

Abbreviated List of Defined Terms

To assist in understanding the scope and content of the foregoing and forthcoming written description and appended claims, a select few terms are defined directly below.

The term "condition" refers to any disorder, disease, injury, or illness, as understood by those skilled in the art, that is manifested or anticipated in a patient. Manifestation of such a condition can be an early, middle, or late stage manifestation, as known in the art, including pre-condition symptoms, signs, or markers. Anticipation of such a condition can be or include the predicted, expected, envisioned, presumed, supposed, and/or speculated occurrence of the same, whether founded in scientific or medical evidence, risk assessment, or mere apprehension or trepidation.

The term "patient," as used herein, is synonymous with the term "subject" and generally refers to any animal under the care of a medical professional, as that term is defined herein, with particular reference to (i) humans (under the care of a doctor, nurse, or medical assistant or volunteer) and (ii) non-human animals, such as non-human mammals (under the care of a veterinarian or other veterinary professional, assistant, or volunteer).

The terms "medical professional" as used herein, generally refers to any individual or entity that is responsible for or participates in providing health care to an animal, including human and non-human animals, such as non-human mammals, with particular emphasis on licensed health care providers or unlicensed providers, such as assistants, technicians, and/or volunteers, particularly those covered under the (blanket) license or insurance of a health care provider. This term may, when contextually appropriate, include an oncologist, a surgeon, a physician's assistant, a nurse, a phlebotomist, a veterinarian, etc.

The term "cancer" refers to an abnormal, typically uncontrolled, growth of cells. A "cancerous cell" as used herein comprises a malignant cell having an abnormal, typically uncontrolled, growth. As such, the term cancer is an umbrella term encompassing a plurality of different distinctive diseases characterized by malignant cells growing in a typically uncontrolled manner.

The term "co-administration" and similar terms refer to concurrent, sequential, and/or combined administration of two or more components. For instance, two components can be co-administered by administering each component in a separate dosage concurrently, simultaneously, or sequentially (e.g., distinct administrations separated by a period of time). The period of time can be very small (e.g., substantially, immediately following a first administration) or longer (e.g., 1-60 seconds, 1-60 minutes, 1-24 hours, 1-7 days, 1-4 weeks, 1-12 months, and so forth, or any value or range of values therebetween). Concurrent or simultaneous administration can include overlapping administration timeframes for the two or more components or administration of a combination product comprising a mixture of the two or more components.

As used herein, "nucleic acid," and similar terms, refer to a naturally occurring or synthetic oligonucleotide or polynucleotide, whether DNA or RNA or DNA-RNA hybrid, single-stranded or double-stranded, sense or antisense. In particular, nucleic acids can include, without limitation, DNA, RNA, cDNA, gDNA, ssDNA, dsDNA or any combination thereof. Nucleic acids of the disclosure can also include nucleotide or nucleic acid analogs (e.g., BrdU), and non-phosphodiester (internucleoside) linkages or backbones (e.g., peptide nucleic acid (PNA) or thiodiester linkages), known in the art.

As used herein, the term "standard amino acid" includes: alanine—ala—A; arginine—arg—R; asparagine—asn—N; aspartic acid—asp—D; cysteine—cys—C; glutamine—gln—Q; glutamic acid—glu—E; glycine—gly—G; histidine—his—H; isoleucine—ile—I; leucine—leu—L; lysine—lys—K; methionine—met—M; phenylalanine—phe—F; proline—pro—P; serine ser—S; threonine—thr—T; tryptophan—trp—W; tyrosine—tyr—Y; and valine—val—V.

As used herein, "codon optimized" or "codon optimization" refers to the process of modifying or changing codons in a nucleotide sequence to codons that are preferred or more closely match the pattern of codon usage in the organism used for expression of the molecule. Thus, codons can be optimized for usage in a particular organism in which expression is desired based on known codon usage in the organism in order to enhance the effectiveness of expression of the nucleic acid, e.g., to achieve faster translation rates and high accuracy. The codon usage in a particular organism is known.

The encoding nucleic acid molecule can be a modified wild-type or a codon optimized sequence, where the codons are optimized for expression in a particular host cell, such as mammalian cells, e.g., CHO cells or 293 cells, or in a yeast, or a plant cell, eukaryotic cells.

In particular examples, the nucleic acid sequence can be codon optimized, for example, to increase expression levels of the encoded sequence. The particular codon usage is dependent on the host organism in which the modified polypeptide is expressed. One of skill in the art is familiar with optimal codons for expression in mammalian or human cells, bacteria or yeast, including for example *E. coli* or *Saccharomyces cerevisiae*. For example, codon usage information is available from the Codon Usage Database available at kazusa.or.jp.codon (see e.g., Richmond (2000) *Genome Biology*, 1:241 for a description of the database. See also, Forsburg (2004) *Yeast*, 10:1045-1047; Brown et al. (1991) *Nucleic Acids Research*, 19:4298; Sharp et al. (1988) *Nucleic Acids Res.*, 12:8207-8211; Sharp et al. (1991) *Yeast*, 657-78).

Therapeutic Proteins

Embodiments of the present disclosure can include one or more therapeutic and/or recombinant human alpha soluble Klotho proteins, protein fragments, and/or protein variants.

The protein can comprise all or a subset of amino acid residues 1-1012, 1-981, 29-981, 34-981, 36-981, 131-981, 1-549, 29-549, 34-549, 36-549, or 131-549 of human alpha Klotho isoform 1 or 2. The protein can have at least and/or about 80% amino acid sequence identity to all or a subset of amino acid residues 1-1012, 1-981, 29-981, 34-981, 36-981, 131-981, 1-549, 29-549, 34-549, 36-549, or 131-549 of human alpha Klotho isoform 1 or 2. For instance, at least a portion of the protein can have at least 80%, etc. amino acid sequence identity to at least a portion of one of SEQ ID NO: 2 through SEQ ID NO: 70 or SEQ ID NO: 107 through SEQ ID NO: 120, or a combination of two or more thereof. Other portions or fragments of the protein sequences described in the present application are also contemplated herein. For instance, some embodiments can include a protein having at least a portion with at least 80%, etc. amino acid sequence identity to any suitable portion of one of SEQ ID NOS: 1-75, or a combination of two or more thereof.

Some embodiments can include a protein having one or more amino acid variations as compared to human alpha Klotho isoform 1. Illustratively, the protein can comprise a human C370 variant. For instance, the protein can include a C370S alteration, thereby comprising S370. The protein can include human F352 or other than F352V in some embodiments. In at least one embodiment, the protein can include the C370S alteration, thereby comprising S370, without a F352V variant, preferably with F352. The protein can include H193 or other than the H193R variant. All other standard amino acid substitutions at amino acid residue (or position) 193, 352, and/or 370 of human alpha Klotho isoform 1 are contemplated and explicitly disclosed herein.

Some embodiments can include a variation at amino acid residue 45 of human alpha Klotho isoform 1. At position 45, the residue can be a valine (Val; V), a phenylalanine (Phe; F), or another amino acid.

The protein can also include one or more glycans (attached thereto). For instance, native human alpha Klotho isoform 1 can have glycans attached (via glycosylation) at amino acids 106, 159, 283, 344, 604, 612, and/or 694. Accordingly, the proteins of the present disclosure, or Klotho protein sequences thereof, can have one or more of the same (or similar) glycans attached (via glycosylation) thereto (e.g., at the same amino acid position(s)). In a preferred embodiment, the protein includes all of the same or similar (native-type) glycans attached thereto, at the same amino acid position(s).

In some embodiments, the protein can include a signal peptide or signaling sequence. For example, the protein can include a native Klotho signaling sequence. The protein can include a non-native or synthetic signaling sequence. In some embodiments, the signaling sequence can be an N-terminal signaling sequence and/or upstream (or N-terminal to) a Klotho protein sequence. In other embodiments, the signaling sequence can be C-terminal or otherwise disposed. Preferably, the signaling sequence can be, comprise, or have at least 80% amino acid sequence identity to native human alpha Klotho isoform 1 signaling sequence, native human alpha Klotho isoform 2 signaling sequence, SEQ ID NO: 71 or SEQ ID NO: 72.

In some embodiments, the protein can include an amino acid tag. The tag can be a C-terminal tag and/or downstream of (or C-terminal to) a Klotho protein sequence. In other embodiments, the tag can be N-terminal or otherwise disposed. The tag can be or comprise an Fc-peptide (or Fc-fusion tag, Fc domain, etc.). For instance, the tag can be or comprise an IgG1-Fc protein sequence. Preferably, the tag can be, comprise, or have at least 80% amino acid sequence identity to SEQ ID NO: 74.

The tag can also, or alternatively, be or comprise a peptide comprising a Twin-Strep protein sequence, such as a Twin-Strep tag or protein sequence (e.g., as known in the art). Preferably, the signaling sequence can be, comprise, or have at least 80% amino acid sequence identity to SEQ ID NO: 75, SEQ ID NO: 102, SEQ ID NO: 103, SEQ ID NO: 104.

The tag can also, or alternatively, be or comprise a polysialic acid (PSA). In at least one embodiment, the PSA tag can render the conjugated (Klotho) protein resistant to one or more proteases. In some embodiments, maintaining an amount (e.g., even a relatively small amount) of sialic acid in the protein conjugate can prevent protease attack and subsequent targeting, breakdown, and clearance of the molecule (e.g., through the liver).

In at least one embodiment, the tag can be cleaved from the protein. In other embodiments, the tag can be retained as part of the protein. In some embodiments, the tag can enhance solubility and/or (serum) half-life of the protein. In some embodiments, the tag can be utilized during protein purification (e.g., as part of a purification mechanism).

In some embodiments, the protein can include a linker (e.g., amino acid linker) disposed between a Klotho protein sequence and an amino acid tag. Illustratively, the linker can comprise between 1 and 40 amino acids, preferably between 5 and 20 amino acids, more preferably between 6 and 12 amino acids, most preferably between about 8 to 10 amino acids. The linker can be or comprise a GS linker (e.g., according to SEQ ID NO: 73) or other linker (e.g., a linker according to SEQ ID NO: 106) in some embodiments. Preferably, the linker can be, comprise, or have at least 80% amino acid sequence identity to SEQ ID NO: 73 or SEQ ID NO: 105.

In at least one embodiment, the protein can be cGMP regulation compliant, as determined and enforced by the U.S. Food and Drug Administration (FDA). For instance, the Klotho protein can be at least 90%, 92%, 95%, 96%, 97%, 98%, or 99% pure, dry weight. In some embodiments, the Klotho protein sample can include less than about 1-100 parts per million (ppm), less than about 100-1000 parts per billion (ppb), or less than about 1-100 ppb CHO host cell proteins (HCP), nucleic acid, and/or other cellular components, or any value or range of values disposed therebetween.

Nucleic Acids and Expression Vectors

Some embodiments can include a nucleic acid or nucleic acid construct. For instance, embodiments can include an expression vector or nucleic acid construct. The nucleic acid can encode a recombinant human alpha soluble Klotho protein, protein fragment, or protein variant, as described herein. In at least one embodiment, the nucleic acid can encode a Klotho protein sequence, an optional (native or non-native) signaling sequence (e.g., at the N-terminus or N-terminal of the Klotho protein sequence), an optional linker sequence (e.g., GS linker), and/or an amino acid tag (e.g., IgG1-Fc or TEV-Twin-Strep), as described herein.

In some embodiments, the nucleic acid can express a protein that includes all or a subset of amino acid residues 1-1012, 1-981, 29-981, 34-981, 36-981, 131-981, 1-549, 29-549, 34-549, 36-549, or 131-549 of human alpha Klotho isoform 1 or 2. At least a portion of the protein can have at least or about 80% amino acid sequence identity to all or a subset of amino acid residues 1-1012, 1-981, 29-981, 34-981, 36-981, 131-981, 1-549, 29-549, 34-549, 36-549, or 131-549 of human alpha Klotho (isoform 1 or 2). For instance, at least a portion of the protein can have at least and/or about 80% amino acid sequence identity to all or a portion of one of SEQ ID NO: 1 through SEQ ID NO: 75, or a combination of two or more thereof. In a preferred embodiment, the protein can have at least and/or about 80% amino acid sequence identity to all or a portion of one of SEQ ID NO: 2 through SEQ ID NO: 70 or SEQ ID NO: 107 through SEQ ID NO: 120.

In some embodiments, at least a portion of the nucleic acid can have at least a portion of the nucleic acid can have at least and/or about 80% (e.g., at least about 82%, 85%, 86%, 87%, 88%, 89%, 90%, 91%, 92%, 93%, 94%, 95%, 96%, 97%, 98%, or 99%, or 100% nucleotide sequence identity to one of SEQ ID NO: 76 through SEQ ID NO: 106 or SEQ ID NO: 121 through SEQ ID NO: 124, or a combination of two or more thereof. In a preferred embodiment, the nucleic acid can have at least and/or about 80% nucleotide sequence identity to one of SEQ ID NO: 76 through SEQ ID NO: 106 or SEQ ID NO: 121 through SEQ ID NO: 124.

Nucleic acid sequences of the present disclosure can also include a stop codon, as known in the art.

Cell Lines and Methods of Manufacture

An embodiment of the present disclosure can include a cell line. The cell line can comprise any suitable cell type, such as CHO cells, HEK cells, HL-60 cells, or other cell line as known in the art. Illustratively, the cell line can comprise CHO cells (e.g., a plurality of CHO cells). In some embodiments, the CHO cells can (each) contain (one or more copies of) an exogenous nucleic acid. The nucleic acid can encode a polypeptide with at least and/or about 80% amino acid sequence identity to at least a portion of one of SEQ ID NO: 1 through SEQ ID NO: 75, or a combination of two or more thereof, preferably to one of SEQ ID NO: 2 through SEQ ID NO: 70.

The nucleic acid can comprise at least one transgene or cDNA. In some embodiments, at least a portion of the nucleic acid can having at least and/or about 80% nucleic acid sequence identity to one of SEQ ID NO: 76 through SEQ ID NO: 106 or SEQ ID NO: 121 through SEQ ID NO: 124, or a combination of two or more thereof, preferably one of SEQ ID NO: 76 through SEQ ID NO: 106 or SEQ ID NO: 121 through SEQ ID NO: 124. The nucleic acid can be or comprise a plasmid or other (structural) form of nucleic acid.

In some embodiments, the exogenous nucleic acid can encode a functional enzyme, such as dihydrofolate reductase (DHFR) and/or glutamine synthetase (GS). In at least one embodiment, the CHO cells can be or comprise dihydrofolate reductase (DHFR)-deficient CHO cells, such as CHO—S cells. The nucleic acid can include a promoter (e.g., a weak up to a strong promoter, as understood by those skilled in the art). For instance, in some embodiments, the nucleic acid can include a (strong) promoter associated with the transgene having at least 80%, etc. nucleic acid sequence identity to one of SEQ ID NO: 2 through SEQ ID NO: 70 or SEQ ID NO: 107 through SEQ ID NO: 120. Thus, the transgene can be under the control of a promoter.

For convenience, CHO cells and/or cell lines are referred to throughout the present disclosure. It is noted, however, that other cells, cell lines and/or host cells (besides CHO cells) are also contemplated within the scope of the present disclosure. Accordingly, a reference to CHO cells and/or cell lines also contemplates reference to and/or use of other known cells, cell lines and/or host cells.

Transfection

A method of manufacturing the CHO cell line can include introducing the exogenous nucleic acid into the CHO cells, preferably via transfection, or other technique, as known in the art. In at least one embodiment, a serum-free growth optimized, cell-suspension of a CHO cell line was used as the host cell line for insertion of a nucleic acid (plasmid) containing a promoter, a human alpha S-klotho transgene encoding a polypeptide with at least 80% amino acid sequence identity to at least a portion of one of SEQ ID NO: 2 through SEQ ID NO: 70 or SEQ ID NO: 107 through SEQ ID NO: 120, and a selectable (enzyme) marker. The transgenes, respectively, encode amino acids 1 through 981, 29 through 981, or 34 through 981 of human alpha soluble Klotho. In particular embodiments, the transgenes had sequence portion(s) corresponding to one or more of SEQ ID NO: 76 through SEQ ID NO: 106 or SEQ ID NO: 121 through SEQ ID NO: 124 (or had at least 80% nucleic acid sequence identity to one of SEQ ID NO: 76 through SEQ ID NO: 106 or SEQ ID NO: 121 through SEQ ID NO: 124). For DHFR-deficient CHO cell lines (such as the CHO—S cell line), the selectable (enzyme) marker was exogenous DHFR. For other CHO cell lines, the selectable (enzyme) marker was exogenous GS.

Growth, Selection and/or Gene Amplification

Some embodiments can include growing the cells (e.g., transfected and/or CHO cells) on a solid medium and/or in a liquid medium (e.g., in suspension cell culture), preferably in a serum-free and/or animal (or animal-derived) protein (component) free medium. For instance, cells can be plated on solid growth media for a period of time. The cells can also or alternatively be grown in suspension culture and/or in liquid medium. The liquid medium preferably comprises a carbon source, a nitrogen source, and one or more vitamins, minerals, salts, amino acids, supplements, or additives. In some embodiments, the medium can also lack hypoxanthine and thymidine (HT), glutamine, etc.

In at least one embodiment, after a certain period of time (e.g., 48 hours post-transfection), the cells can be gathered (e.g., detached), optionally centrifuged (e.g., at 100×g for 5 min.), and/or seeded (e.g., at approximately 2000 cells/well), such as into a 96-well adherent culture plate (e.g., containing serum supplemented, —HT and/or —glutamine media). The medium can also include MTX and/or MSX in certain embodiments. Non-transfected cells may die within 7-14 days after selection (e.g., after exposure to MTX and/or MSX in —HT and/or —glutamine media.

In certain embodiments, the CHO cells can (be selected to) contain at least about 2 to 10 copies, at least about 10 to 20 copies, at least about 20 to 30 copies, or at least about 30 to 50 copies of the exogenous nucleic acid (e.g., per cell). Accordingly, the method can include selecting CHO cells that contain at least about 2 to 10 copies, at least about 10 to 20 copies, at least about 20 to 30 copies, or at least about 30 to 50 copies of the exogenous nucleic acid (e.g., per cell). For instance, (successively increasing levels of) MTX and/or MSX can be administered to the cells (e.g., at a concentration of about 1 nM-1 μM, about 10-100 nM, etc.).

Dihydrofolate reductase (DHFR) gene amplification in DHFR-deficient CHO cells (such as the CHO—S cell line) transfected with exogenous DHFR, was accomplished by successively increasing levels of methotrexate (MTX) in growth medium. Because the plasmid contains DHFR, this allows for the amplification of the S-klotho gene (fragment) within the host cell upon exposure to MTX (10-100 nM). The GS gene expression system was also used to amplify CHO cells transfected with exogenous GS (e.g., upon exposure to MSX). Alternatively, GS −/− host cell lines were also used, which removed the need for MSX. These steps resulted in the production of numerous copies of the S-klotho gene (e.g., between to 30 copies of the gene per cell) and resultant high levels of expression of the S-klotho protein in the transgenic cell line.

In suspension culture, the protein can be secreted from the CHO cells into the liquid medium in some embodiments. For instance, certain CHO cells and/or cell lines of the present disclosure can secrete (or be selected to secrete) up to a concentration of 200-500 mg of protein per liter of liquid medium, 500-2000 mg of protein per liter of liquid medium, 2000-5000 mg of protein per liter of liquid medium, or any value or range of values therebetween (without concentrating the protein). In at least one embodiment, high producing cell lines (or suspension cultures) can be selected, such that the concentration of human recombinant alpha soluble Klotho protein in the medium (of the selected suspension culture or suspension cultures of the selected cell lines) is at least 200 mg/L, preferably at least 500 mg/L, more preferably at least 1000 mg/L, even more preferably at least 2000 mg/L, still more preferably at least 5000 mg/L, without concentrating the protein.

Sub-cloning of the resultant high S-klotho producing, transgene-containing colonies by limited cell dilution was conducted to further produce S-klotho-secreting CHO cell lines that secrete in the range of 500 to 2000 mg/L S-klotho into the cells conditioned media. All cell constructs were restriction digested and sequence verified.

In some embodiments, the CHO cells can be grown in a bioreactor having a volume or working volume of at least 10 liters, preferably at least 25 liters, more preferably at least liters, even more preferably at least 100 liters, still more preferably at least 250 liters, still more preferably at least 500 liters, still more preferably at least 1,000 liters, still more preferably at least 2,000 liters, still more preferably at least 2,500 liters, still more preferably at least 5,000 liters, still more preferably at least 10,000 liters.

Cell Line Maintenance

For the amplified high-producing S-Klotho cell lines (e.g., produced by DHFR/MTX or GS/MSX systems), optionally followed by cell subcloning, judicious use of concentrated media feeds administered to the production cell lines during scale-up and up to the final bioreactor run were done in serum-free and animal protein component-free basal media.

Scale-up of high producer cell lines was done by cell inoculum expansion in cell suspension in shake flasks or in the Wave Bag systems followed by the successive inoculation of the cells produced in 100 L and then 500 L capacity bioreactors. Cell viability was maintained at greater than 85% viable cells throughout the growth cycle in shake flasks, Wave Bags, or bioreactors; and then at 80% or greater viable cell counts in bioreactors during the plateau phase of CHO S cellular growth with the concomitant production of up to 1-3 g/L of S-klotho produced (designated as the "high producers").

Protein Production

Certain embodiments can employ recombinant DNA strategies that utilize strong promoter sequences and/or high copy number plasmids for production of therapeutic amounts of the Klotho protein in mammalian (e.g., CHO) cells. In at least one embodiment, for example, dihydrofolate reductase (DHFR) gene amplification in DHFR-deficient CHO cells can include providing and/or the use of (successively increasing levels of) methotrexate (MTX). Similarly, exogenous glutamine synthetase (GS) gene-containing CHO cells can be treated with methionine sulphoximine (MSX).

The Klotho protein can also include one or more glycans (attached thereto). For instance, the native human alpha Klotho isoform 1 (SEQ ID NO: 1) can have glycans attached (via glycosylation) at amino acids 106, 159, 283, 344, 604, 612, and/or 694. The Klotho protein of the present disclosure can have one or more of the same (or similar) glycans attached (via glycosylation) thereto (e.g., at the same amino acid(s)).

In at least one embodiment, the protein can be cGMP regulation compliant, as determined and enforced by the U.S. Food and Drug Administration (FDA). For instance, the Klotho protein can be at least 90%, 92%, 95%, 96%, 97%, 98%, or 99% pure, dry weight. In some embodiments, the Klotho protein sample can include less than about 1-100 parts per million (ppm), less than about 100-1000 parts per billion (ppb), or less than about 1-100 ppb CHO host cell proteins (HCP), nucleic acid, and/or other cellular components, or any value or range of values disposed therebetween.

Glycan structures present of the S-Klotho proteins produced can be similar or identical in comparison to the structures on native S-klotho structure isolated from human fluids (i.e., blood, sera, urine, cerebrospinal fluid). In at least one embodiment, confirmation of native-like glycans can ensure that the right native post-translation modifications (PTMs) are produced and stably maintained in the S CHO cell-produced S-Klotho protein.

Solubility and/or Half-Life Extension of Klotho Proteins

Disclosed are methods and compositions for extending the half-life and increasing the solubility of the human S-Klotho protein. Also, the purification and characterization of the protein constructs so produced to achieve these result are also the subject matter of the present disclosure. Relevant information regarding nucleic acid changes made in the sequence of the klotho gene or nucleic acid construct (see SEQ ID NOS: 76-96) and/or of changes, or chemical alterations in the amino acid sequence of a Klotho protein (see SEQ ID NOS: 1-70), and/or additions or subtraction of chemical groups, peptides, or proteins to the amino acid sequence of a Klotho protein is taught in the present disclosure in order to obtain resultant human Klotho variant proteins (novel compositions) with increased biological half-life or increased solubility in biological matrices (such as in blood, cerebrospinal fluid, urine, or various human tissues) than that of native Klotho molecules. These novel compositions can be made through the methods described herein for the modification of the S-Klotho protein.

Illustratively, fusion protein constructs can be produced by combining the S-Klotho protein with the Fc domains of an antibody (IgG), an albumin, such as human serum albumin (HSA), a transferrin, such as human transferrin (TF), and/or a proprietary recombinant polypeptide such as XTEN®. The novel proteins can also be produced by conjugating (or modifying) the S-Klotho protein with a posttranslational modification, such as polysialic acid (PSA) or pegylation. Moreover, a novel S-Klotho protein can be produced through pegylation. The foregoing and other (half-life extension) methodologies can improve the performance of the S-Klotho protein by one or more of: increasing the S-Klotho dosing interval; providing superior patient convenience and likely compliance; reducing dosing frequency requirement, resulting in lower drug use in the aggregate; reducing the cost of the drug; lower drug quantities at the same dosing interval as the parent protein; simplifying dosage formulation and enable subcutaneous formulation; providing higher drug levels using the same dose and dosing interval as the parent protein resulting in longer drug exposure and potentially better efficacy; and decreasing the immunogenicity of S-Klotho.

Production of Fc Domain Fusion Protein Constructs of S-Klotho

Antibody Fc domain, human serum albumin (HSA), and polysialic acid (PSA) were tested for effectiveness in extending the half-life and increasing the solubility of the human S-Klotho protein. Fc fusions involve the fusion of peptides, proteins or receptor exodomains to the Fc portion of an antibody. Both Fc and albumin fusions achieve extended half-lives not only by increasing the size of the peptide drug, but both also take advantage of the body's natural recycling mechanism through binding of the extended protein to the neonatal Fc receptor, FcRn. After binding of the extended protein to the FcRn receptor, degradation of the fusion protein in the cells' endosome is prevented. Fusions based on the addition of Fc or albumin can result in biological half-lives in the range of 3-16 days, much longer than which has been reported for typical pegylated or lipidated peptides. For a review that describes the use of protein fusion technologies such as Fc fusion proteins, fusion to human serum albumin, fusion to carboxy-terminal peptide, and other polypeptide fusion approaches to make biobetter drugs with more desirable pharmacokinetic profiles see Strohl WR. Fusion Proteins for Half-Life Extension of Biologics as a Strategy to Make Biobetters. *Biodrugs.* 2015; 29(4):215-239, the entirety of which is incorporated herein by specific reference.

Fc domains were thusly added to the parent protein (S-Klotho) to increase binding affinity to the Fc receptor (FcRn). FcRn is present inside lysosomes in endothelial cells lining the blood vessels and functions to rescue antibodies from the degradation that makes most proteins short-lived in circulation. As a result of interactions with FcRn, proteins have half-lives ranging from a few days to a few weeks, allowing for less frequent dosing of the extended form of the protein drugs than biologics that do not have this newly-produced composition-of-matter.

The dimeric nature of Fc versus the monomeric structure of HSA can lead to the presentation of a Fc fused peptide as a dimer or a monomer in contrast to HSA. The dimeric nature of a peptide Fc fusion can produce an avidity effect if the target receptors for S-Klotho are spaced closely enough together or are themselves dimers in particular human target organs. This may be desirable or not depending on the target. Fusion of the S-Klotho protein to antibody Fc is also taught in the present disclosure to improve the solubility and stability of S-Klotho. The addition of Fc domains to S-Klotho will also allow the fusion protein to be less immunogenic upon administration in human subjects.

Conjugation of the S-Klotho Protein with Human Serum Albumin (HSA)

The 66.5 kDa protein HSA, similar to human IgGs, has a long average half-life in the 19-day range. At a concentration of ~50 mg/mL (~600 HSA is the most abundant protein in human plasma, where it has several functions, including maintenance of plasma pH, metabolite and fatty acid transport, and a role in maintaining blood pressure. HSA, which is at the upper limit of size for glomerular filtration of proteins by the kidney, is also strongly anionic, which helps even more to retard its filtration via the kidney. Like IgGs, HSA also binds FcRn in a pH-dependent manner, albeit at a site different from—and via a mechanism distinct from— that of IgG binding, and is recycled similarly to IgGs, resulting in its extended half-life. HSA also tends to accumulate in tumors and in inflamed tissues, which suggests that fusion or binding to albumin may potentially help to target proteins or peptides to those sites.

The fusion of peptides or proteins with inherently short-half-life properties to HSA for prolongation of the serum half-life of the these molecules has been investigated broadly since the early 1990s. Since then, dozens of different peptides and small proteins have been fused to HSA as both innovative and potential biobetter molecules. The first HSA-peptide or protein fusion product to be approved for marketing was Tanzeum® (marketed as Eperzan® in the European Union) a DPP-4-resistant GLP-1-HSA fusion protein discovered at Human Genome Sciences and developed and marketed by GlaxoSmithKline. Tanzeum® (albiglutide) was approved by the European Medicines Agency (EMA) and the FDA in March and April of 2014, respectively. HSA thus improved the half-life of pharmacologically active GLP-1 from 1-2 min for native GLP-1 to 4-7 days, which allows for once weekly dosing. Seven other known HSA fusion protein product candidates are either now in development or recently have been in development. Also, Novozyme, has been developing modified versions of recombinant HSA with improved FcRn binding for construction of "next-generation" HSA-protein fusions that may possess even longer half-life properties. This was based on the use of a K573P mutant of HSA, which was found to possess 12-fold greater affinity for FcRn, conferred a longer half-life on HSA than the wild type molecule in both mice and cynomolgus monkeys. The expectation is that these longer-half-life mutants of HSA may of further use as fusion proteins to improve the half-life of fusion proteins.

The Inventors herein therefore disclose that we may fuse our Klotho protein to wild type HSA or to a mutant form of HSA to produce a Klotho fusion molecule(s) with significantly prolonged half-life in human blood, cerebral spinal fluid, and other human biological matrices in order to bring about a strategic therapeutic benefit such as superior patient convenience and likely compliance, reduced dosing frequency results in lower drug use in aggregate, and/or reduced cost of goods. Also lower drug quantities at the same dosing interval as the parent protein may simplify dosage formulation and enable subcutaneous formulation or decrease in the immunogenicity of S-Klotho.

Conjugation of the S-Klotho Protein with Human Transferrin (TF)

Transferrin is a highly abundant serum glycoprotein, found in serum at 3-4 mg/mL, which binds iron tightly but reversibly and functions to carry iron to tissues. Transferrin has 679 amino acid residues, is about 80 kDa in size, and possesses two high-affinity $Fe^{3+}$-binding sites, one in the N-terminal domain and the other in the C-terminal domain. Human transferrin has a half-life reported to be 7-10 days or 10-12 days. The aglycosylated form of human transferrin, which makes up about 2-8% of the total transferrin pool, has a slightly longer half-life of 14-17 days. The extended persistence of transferrin in human serum is due to a clathrin-dependent transferrin receptor-mediated mechanism, which recycles receptor-bound transferrin back into the circulation.

Fusions of peptide and proteins have been made to human transferrin to the N- and C-termini, as well as to the centrally located hinge region that links the two major lobes of transferrin together. The N terminus of transferrin is free and can be fused directly. The C terminus is more buried and is constrained by a nearby disulfide bond, so flexible linkers are typically used when proteins are fused to the C terminus. This capability was extended by making libraries of peptides against specific targets and then fusing binders from those libraries into aglyco-transferrin (N-terminal, C-terminal, loops, or linker region) to be developed into therapeutic fusion proteins with extended half-lives.

The biotechnology company BioRexis Technologies, Inc., was founded in 2002 to develop the transferrin fusion protein platform, which they termed the "Trans Body" platform, as a therapeutic platform. Their lead molecule, BRX-0585, was a transferrin-GLP-1 fusion protein for treatment of type 2 diabetes mellitus (T2DM). Fusion of GLP-1 to transferrin was demonstrated to significantly enhance the half-life of GLP-1. BioRexis was acquired by Pfizer in March 2007. As far as can be determined, no BioRexis-derived fusion proteins are currently in the clinic. Klotho protein can be fused to human transferrin to produce a Klotho fusion molecule and administer it clinically to significantly prolong half-life or stability in human biological matrices in vivo.

Conjugation of the S-Klotho Protein with XTEN from Amunix

XTEN® is a proprietary recombinant polypeptide that extends the in vivo half-life of therapeutic payloads. XTEN consists of naturally-occurring hydrophilic amino acids and is biodegradable. Pharmaceuticals such as proteins, peptides, and synthetic compounds can be XTENylated via chemical conjugation or genetic fusion. XTEN proteins lack secondary and tertiary structure and their solution behavior resembles chemically prepared polymers with very large hydrodynamic radii. By size exclusion chromatography, XTEN protein polymers appear much larger than typical globular proteins of similar molecular weight. The bulking effect of XTEN greatly reduces renal clearance of attached molecules, thus greatly increasing their in vivo half-lives. In the current invention, the length of XTEN polymers added to a Klotho protein will be customized to optimize the pharmacokinetics as well as the bio-distribution of the attached Klotho protein payloads.

XTEN thusly can be recombinantly-fused to our S-Klotho protein to increase the molecules in vivo half-life. One benefit is that with the genetic S-Klotho-XTEN fusion constructs, a molecule is produced that has the convenience of expression, purification and characterization of a single molecule which includes both the therapeutic and bulking moieties. Recombinant fusion allows attaching multiple XTEN chains per protein in precisely-defined locations have been successfully used by therapeutic drug manufacturer that has resulting in best-in-class pharmacokinetics as exemplified by XTENylated growth hormone (Somavaratan, with the company, Versartis) and FVIII-XTEN (with the company, Biogen). For example, pharmacokinetics conducted in children receiving different doses of XTENylated growth hormone (Somavaratan, Versartis) have shown an optimization of the Somavaratan molecule to reduce receptor-mediated elimination in addition to kidney clearance resulting in a best-in-class half-life.

XTEN protein polymers can be produced as free intermediates for chemical conjugation to peptides, peptidomimetics, and other synthetic molecules. Reactive groups (thiol, amine) are inserted in precisely-defined positions via introduction of cysteine or lysine residues into XTEN-encoding genes. Amunix has developed XTENs containing 1 to 9 thiol groups with various spacing which can be provided to partners. Thus, in the present invention, orthogonal conjugation to amino and thiol groups in XTEN will facilitates the production of our Klotho-XTEN molecules.

Purification of Proteins

The Klotho protein can be extracted from cell suspension culture of CHO cells (e.g., of a CHO cell line). The CHO cells can produce and optionally secrete the Klotho protein (e.g., into liquid medium). Secretion of S-klotho into the cells spent media was also observed.

Purification of the recombinant proteins of the present disclosure can be carried out by any suitable method known in the art or described herein, for example, any conventional procedures involving extraction, precipitation, chromatography and/or electrophoresis. A further purification procedure that can be used for purifying proteins includes affinity chromatography using monoclonal antibodies which bind a target protein. Some embodiments can include an IgG-tagged protein that can be purified by affinity chromatography. For instance, some embodiments can include at least a portion of an Fc domain of an IgG, such as IgG1. Generally, crude preparations containing a recombinant protein are passed through a column on which a suitable monoclonal antibody is immobilized. The protein usually binds to the column via the specific antibody while the impurities pass through. After washing the column, the protein is eluted from the gel by changing pH or ionic strength. For example, the spent media from the CHO—S high producer cell lines was concentrated via tangential flow filtration; and S-klotho protein was purified by affinity chromatography followed by ion exchange cartridge or column chromatography. Size exclusion chromatography can also be used purify the proteins.

In alternative protocols, one or more pre- or post-affinity purification steps were performed. Such steps can include, for example, (ultra) centrifugation, dialysis, membrane and/or tangential flow filtration, chromatographic separation, such as ion exchange, liquid-liquid extraction, such as (aqueous) two-phase extraction, or other known purification steps. One or more post purification processing steps were performed in certain embodiments. Such post purification processing steps can include, for example, tandem anion/cation flow-through chromatography (as opposed to bind-and-elute chromatography), viral and/or bacterial removal by membrane filtration (e.g., 0.2 micron, 0.1 micron, etc.) or by other means known to one of ordinary skill in the art.

Analysis of Klotho Proteins

Protein purity can be demonstrated by SDS-PAGE or other assays or means known in the art. For instance, in at least one embodiment, Klotho protein samples (50 μg) were fractionated on precast SDS-PAGE gels (4-15%, 10 wells; catalog no. 456-1083; BioRad) and stained with Coomassie blue stain. All samples were run with either an empty lane in between or on separate gels to avoid sample-to-sample contamination. S-klotho of greater than 98% was shown to be isolated from the CHO S conditioned media as determined by Coomaise blue stain and densitometry tracing, or by silver stain visualization, or by HPLC or RP-HPLC. In order to obtain sequence information, the proteins (after reduction and S-carboxymethylation) can be cleaved with cyanogen bromide, trypsin, and/or proteinase K and the peptides separated by HPLC according to known methods of protein chemistry. Thus-prepared samples were then sequenced in an automatic gas phase microsequencing apparatus (Applied Biosystems Model 470A, ABI, Foster City, Calif, USA) with an on-line automatic HPLC PTH amino acid analyzer (Applied Biosystems Model 120, ABI see above) connected to the outlet.

Proteins were also be analyzed through mass spectroscopic methods. Concerning sample preparation for mass spectrometry, in order to restrict analyses to the correct S-klotho protein, only the gel band between 75 and 150 kDa was resected for analysis. Gel fractions were macerated with a sterile blade and subjected to in-gel digestion. Gel fractions were destained by three washes with 80 μL of 50% acetonitrile (ACN)/50 mm ammonium hydrogen carbonate and washed with 100% ACN. The alkylation step was omitted, given the absence of cysteine residues from the target α-Klotho peptides. Tryptic digestion was carried out overnight at 37° C. with 60 μL of trypsin (sequencing grade modified, catalog no. V511A; Promega) in 50 mm ammonium hydrogen carbonate (0.005 μg/μL). This process yielded 25 μL, of which 5 μL (1 μL for S-Klotho) was subjected to liquid chromatography-electrospray ionization tandem mass spectrometry (MS/MS) and PRM analysis in an Orbitrap nano-ESI Q-Exactive mass spectrometer (Thermo Scientific), coupled to a nanoLC (Dionex Ultimate 3000 UHPLC). MS/MS analysis confirmed that the human recombinant alpha S-klotho produced by embodiments of the present disclosure was substantially similar (e.g., identical in corresponding amino acid sequence) to that found in human blood, serum, urine or cerebrospinal fluid.

Using the above purification methods, the level of contaminating CHO host cell proteins (HCP) was determined to be acceptable in the purified S-Klotho protein. In the final S-Klotho product, HCP was removed to <1-100 ppm. S-klotho protein products of at least 90%, and up to 98% purity were isolated from the spent CHO S production cell line (cells and/or liquid medium). Specifically, cGMP-grade human alpha S-klotho that had an analytical profile suitable for clinical administration in human subjects was produced and purified. For example, the analytical profile of human recombinant alpha S-Klotho is designated by reference number PXD002775 in the ProteomeXchange Database, which can be found at proteomecentral(dot)proteomexchange(dot)org/cgi/GetDataset?ID=PXD002775. The NIH full S-Klotho protein dataset is at ncbi(dot)nlm(dot)nih(dot)gov/protein/Q9UEF7.

An analytical profile for S-Klotho suitable for clinical administration and that obtained in an embodiment of the present disclosure included an endotoxin level less than 0.1 ng per µg (1 EU/µg) of S-Klotho. In addition, the purified human recombinant S-Klotho was also shown to have > or =98% purity by SDS PAGE.

Glycan structures present on the CHO S cell-produced S-Klotho were identical in comparison to the structures on native S-Klotho isolated from human fluids (i.e., blood, sera, urine, and cerebrospinal fluid). This ensured that the same, native post-translation modifications (PTMs) were produced and stably maintained in the S CHO cell produced S-Klotho protein. Accordingly, using production and purification method described herein, we have been successful in producing cGMP-grade human S-klotho that had an analytical profile suitable for clinical administration in human subjects.

Therapeutic Compositions

Some embodiments of the present disclosure can include a pharmaceutical composition, such as a therapeutic composition. Pharmaceutical compositions of the present disclosure can generally include a therapeutically effective amount of a recombinant soluble alpha Klotho protein admixture with a (pharmaceutically-acceptable) vehicle, carrier, or excipient comprised of one or more additional components. The components can include one or more aggregation inhibitors, buffers, tonicity modifiers, and additional excipients. The primary solvent in carrier can be either aqueous or non-aqueous in nature. The composition can be prepared by combining a purified Klotho protein of the present disclosure with a pharmaceutically-acceptable carrier.

It will be understood one of ordinary skill in the art that the combining of the various components to be included in the composition can be done in any appropriate order, namely, the buffer can be added first, middle or last and the tonicity modifier can also be added first, middle or last. It is also to be understood by one of ordinary skill in the art that some of these chemicals can be incompatible in certain combinations, and accordingly, are easily substituted with different chemicals that have similar properties but are compatible in the relevant mixture.

Aggregation inhibitors reduce a polypeptide's tendency to associate in inappropriate or unwanted ternary or quaternary complexes. The amino acids L-arginine and/or, L-cysteine, can act to reduce aggregation of Fc domain containing polypeptide in a formulation for long periods, e.g., two years or more. The concentration of the aggregation inhibitor in the formulation is preferably between about 1 mM to 1M, more preferably about 10 mM to about 200 mM, more preferably about 10 mM to about 100 mM, even more preferably about 15 mM to about 75 mM, and yet more preferably about 25 mM. These compounds are available from commercial suppliers.

Compositions of the present disclosure can include a buffering agent. Buffering agents maintain pH in a desired range. Various buffers suitable for use in the pharmaceutical composition of the present disclosure include histidine, potassium phosphate, alkali salts, sodium or potassium phosphate or their hydrogen or dihydrogen salts, sodium citrate or potassium citrate/citric acid, sodium acetate/acetic acid, maleic acid, ammonium acetate, tris-(hydroxymethyl)-aminomethane (tris), various forms of acetate and diethanolamine, and any other pharmaceutically acceptable pH buffering agent known in the art, to maintain the pH of the solution within a desired range. Mixtures of these buffering agents may also be used.

The amount of buffering agent useful in the composition depends largely on the particular buffer used and the pH of the solution. For example, acetate is a more efficient buffer at pH 5 than pH 6 so less acetate may be used in a solution at pH 5 than at pH 6. The preferred pH of the preferred formulations will be in the range of 4.0 to 5.0, and pH-adjusting agents such as hydrochloric acid, citric acid, sodium hydroxide, or a salt thereof, may also be included in order to obtain the desired pH.

One preferred buffer is sodium phosphate as its buffering capacity is at or near pH 6.2. It will be appreciated, however, that other buffers may be selected to achieve any desireable pH buffering. The concentration of the buffer in the formulation is preferably between about 1 mM to about 1M, more preferably about 10 mM to about 200 mM. Buffers are well known in the art and are manufactured by known methods and available from commercial suppliers.

When the pH of the pharmaceutical composition is set at or near physiological levels comfort of the patient upon administration is maximized. In particular, it is preferred that the pH be within a range of pH about 5.8 to 8.4, with about 6.2 to 7.4 being preferred, however, it is to be understood that the pH can be adjusted as necessary to maximize stability and solubility of the polypeptide in a particular formulation and as such, a pH outside of physiological ranges, yet tolerable to the patient, is within the scope of the disclosure.

The formulations of the present disclosure may further include one or more tonicity modifiers (e.g., to render the solution isotonic with a patient's blood for injection). A tonicity modifier is understood to be a molecule that contributes to the osmolality of a solution. The osmolality of a pharmaceutical composition is preferably regulated in order to maximize the active ingredient's stability and also to minimize discomfort to the patient upon administration. Where serum is approximately 300+/−50 milliosmolals per kilogram. It is generally preferred that a pharmaceutical composition be isotonic with serum, i.e., having the same or similar osmolality, which is achieved by addition of a tonicity modifier, thus it is contemplated that the osmolality can be from about 180 to about 420 milliosmolals, however, it is to be understood that the osmolality can be either higher or lower as specific conditions require.

Typical tonicity modifiers are well known in the art and include but are not limited to various salts, amino acids or polysaccharides. Non-limiting examples of suitable amino acids include glycine. Non-limiting examples of suitable polysaccharides include sucrose, mannitol and sorbitol. It is understood that more than one tonicity modifier may be used at once, for example, sorbitol and glycine can be used in combination to modify a formulation's tonicity.

Additional examples of tonicity modifiers suitable for modifying osmolality include, but are not limited to amino acids (e.g., arginine, cysteine, histidine and glycine), salts (e.g., sodium chloride, potassium chloride and sodium citrate) and/or saccharides (e.g., sucrose, glucose and mannitol). The concentration of the tonicity modifier in the formulation is preferably between about 1 mM to 1M, more preferably about 10 mM to about 200 mM. Tonicity modifiers are well known in the art and are manufactured by known methods and available from commercial suppliers.

Excipients, also referred to as chemical additives, co-solutes, or co-solvents, that stabilize the polypeptide while in solution (also in dried or frozen forms) can also be added to a pharmaceutical composition. Excipient is defined herein as a non-therapeutic agent added to a pharmaceutical composition to provide a desired effect, e.g. stabilization, isotonicity. Common attributes of desirable excipients are aqueous solubility, non-toxicity, non-reactivity, rapid clearance from the body, and the absence of immunogenicity. In addition, the excipients should be capable of stabilizing the native conformation of the protein so as to maintain the efficacy and safety of the drug during processing, storage and administration to the patient. Examples include but are not limited to sugars/polyols such as: sucrose, lactose, glycerol, xylitol, sorbitol, mannitol, maltose, inositol, trehalose, glucose; polymers such as: serum albumin (bovine serum albumin (BSA), human SA or recombinant HA), dextran, PVA, hydroxypropyl methylcellulose (HPMC), polyethyleneimine, gelatin, polyvinylpyrrolidone (PVP), hydroxyethylcellulose (HEC); non-aqueous solvents such as: polyhydric alcohols, (e.g., PEG, ethylene glycol and glycerol) dimethysulfoxide (DMSO) and dimethylformamide (DMF); amino acids such as: proline, L-serine, sodium glutamic acid, alanine, glycine, lysine hydrochloride, sarcosine and gamma-aminobutyric acid; surfactants such as: Tween-80™ (polysorbate 80), Tween-20™ (polysorbate 20), SDS, polysorbate, polyoxyethylene copolymer; and miscellaneous excipients such as: potassium phosphate, sodium acetate, ammonium sulfate, magnesium sulfate, sodium sulfate, trimethylamine N-oxide, betaine, metal ions (e.g., zinc, copper, calcium, manganese, and magnesium), CHAPS, monolaurate, 2-O-beta-mannoglycerate or any combination of the above.

The concentration of one or more excipients in a formulation of the disclosure is/are preferably between about 0.001 to 5 weight percent, more preferably about 0.1 to 2 weight percent. Excipients are well known in the art and are manufactured by known methods and available from commercial suppliers.

In one illustrative embodiment, a formulation of the disclosure can comprise about 150 mM NaCl buffered to pH 7.3 to 7.4 with HEPES, MES, or Tris-HCl, and, optionally, one or more additional components as described herein.

In one illustrative embodiment, a formulation of the disclosure can comprise about to about 50 mg TNFR:Fc (etanercept), about 10 mM to about 100 mM L-arginine, about mM to about 50 mM sodium phosphate, about 0.75% to about 1.25% sucrose, about 50 mM to about 150 mM NaCl, at about pH 6.0 to about pH 7.0. In another embodiment, L-arginine can be replaced with L-cysteine (at about 1 to about 500 micromolar) in the formulation. In yet another embodiment, the pH can be about pH 7.0. In another specific embodiment, a formulation of the disclosure can comprise about 25 mg/ml TNFR:Fc, about mM L-arginine, about 25 mM sodium phosphate, about 98 mM sodium chloride, and/or about 1% sucrose at about pH 6.2.

In another embodiment, a formulation of the disclosure can comprise about 10 to about 100 mg/mL of RANK:Fc in about 10 mM to about 100 mM L-arginine, about 10 mM to about 50 mM sodium phosphate, about 0.75% to about 1.25% sucrose, about 50 mM to about 150 mM NaCl, at about pH 6 to about pH 7. In a specific embodiment, the formulation of the disclosure comprises 50 mg/ml RANK:Fc in about 25 mM L-arginine, about 25 mM sodium phosphate, about 98 mM sodium chloride, and/or about 1% sucrose at about pH 6.2.

In yet another embodiment, a formulation of the disclosure can comprise an effective amount of an Fc domain containing polypeptide, about 10 mM to about 100 mM L-arginine, about 10 mM to about 50 mM sodium phosphate, about 0 to 5% Mannitol and/or 0 to 0.2% Tween-20™ (polysorbate 20) at about pH 6 to 7. In another embodiment, a formulation of the disclosure can comprise an effective amount of an antibody, such as Emab (an anti-CD22 specific antibody), about 25 mM L-arginine, about 25 mM sodium phosphate, about 4% Mannitol, about 0.02% Tween-20™ (polysorbate 20), and/or at about pH 6.0.

In yet another embodiment, the disclosure provides a method of treating a mammal comprising administering a therapeutically effective amount of the pharmaceutical composition described herein, wherein the mammal has a disease or disorder that can be beneficially treated with a Fc domain containing polypeptide in the composition. In yet another embodiment, the Fc domain containing polypeptide is derived from the same species of mammal as is to be treated with the composition. In a particular embodiment, the mammal is a human patient in need of treatment. When the Fc domain containing polypeptide of the composition is TNFR:Fc, examples of diseases or disorders that can be treated include but are not limited to rheumatoid arthritis, psoriatic arthritis, ankylosing spondylitis, Wegener's disease (granulomatosis), Crohn's disease (or inflammatory bowel disease), chronic obstructive pulmonary disease (COPD), Hepatitis C, endometriosis, asthma, cachexia, psoriasis, and atopic dermatitis, or persons with a genetic disorder with mutations in one or more Klotho genes. Additional diseases or disorders that can be treated with TNFR:Fc include those described in WO 00/62790, WO 01/62272 and U.S. Patent Application No. 2001/0021380, the relevant portions of which are incorporated herein by reference.

In yet another embodiment, the disclosure provides a method for accelerated stability testing of the stability an Fc domain containing polypeptide in a pharmaceutical composition of the disclosure comprising the steps of testing the activity of the polypeptide formulated according to the disclosure prior to storage, i.e., time zero, storing the composition at 37° C. for one month and measuring the stability of the polypeptide, and comparing the stability form time zero to the one month time point. This information is helpful for early elimination of batches or lots that appear to have good stability initially, yet do not store well for longer periods.

Moreover, the pharmaceutical composition provides long-term storage such that the active ingredient, e.g., an Fc domain containing polypeptide, is stable over the course of storage either in liquid or frozen states. As used herein, the phrase "long-term" storage is understood to mean that the pharmaceutical composition can be stored for three months or more, for six months or more, for one year or more, and preferably for two year or more. Long term storage is also understood to mean that the pharmaceutical composition is stored either as a liquid at 2-8° C. or is frozen, e.g., at −20° C. or colder (e.g., −20° C. or −80° C.). It is also contemplated that the composition can be frozen and thawed more than once. The term "stable" with respect to long-term storage is understood to mean that the active polypeptide of the pharmaceutical composition does not lose more than 20%, or more preferably 15%, or even more preferably 10%, and most preferably 5% of its activity relative to activity of the composition at the beginning of storage.

One or more anti-oxidants can be included in the formulations of the present disclosure. Anti-oxidants contemplated for use in the preparation of the formulations include amino acids such as glycine and lysine, chelating agents such as EDTA and DTPA, and free-radical scavengers such as sorbitol and mannitol.

Other effective administration forms such as an oral or parenteral release formulations (e.g., coated, encapsulated, slow-release, controlled-release, extended-release, delayed-release, sustained-release, etc.), inhalant mists, orally-active formulations, or suppositories are also envisioned. As such, the formulations may also involve particulate preparations of polymeric compounds such as bulk erosion polymers (e.g., poly(lactic-co-glycolic acid) (PLGA) copolymers, PLGA polymer blends, block copolymers of PEG, and lactic and glycolic acid, poly(cyanoacrylates)); surface erosion polymers (e.g., poly(anhydrides) and poly(ortho esters)); hydrogel esters (e.g., pluronic polyols, poly(vinyl alcohol), poly(vinylpyrrolidone), maleic anhydride-alkyl vinyl ether copolymers, cellulose, hyaluronic acid derivatives, alginate, collagen, gelatin, albumin, and starches and dextrans) and composition systems thereof; or preparations of liposomes or microspheres. Such formulations may influence the physical state, stability, rate of in vivo release, and rate of in vivo clearance of the present proteins and derivatives. The optimal pharmaceutical formulation for a desired protein can be determined by one skilled in the art depending upon the route of administration and desired dosage. Exemplary pharmaceutical formulations are disclosed in *Remington's Pharmaceutical Sciences*, 18th Ed. (1990), Mack Publishing Co., Easton, Pa. 18042, pages 1435-1712, the disclosure of which is incorporated herein by reference.

Biological Activity

Methods for evaluating the efficacy and/or determining an effective dose of human recombinant alpha soluble Klotho (to a patient, subject, or individual exhibiting an age-related disorder or metabolic disorder) can (preliminarily) include performing an organismal-based assays (e.g., using a mammal (e.g., a mouse, rat, primate, or some other non-human), or other animal (e.g., *Xenopus*, zebrafish, or an invertebrate such as a fly (e.g., *Drosophila melanogaster*) or nematode (e.g., *Caenorhabditis elegans*). The Klotho protein can be administered to the organism once or as a regimen (regular or irregular). For instance, the protein can be administered a suitable number of times (e.g., once, twice, etc.) in a given period of time (e.g., monthly, semi-monthly, weekly, semi-weekly, daily, etc.). A parameter of the organism (e.g., an age-associated parameter) can then be evaluated. Klotho proteins of interest can effectuate or result in a change in the parameter relative to a reference (e.g., a parameter of a control organism). Other parameters (e.g., related to toxicity, clearance, and pharmacokinetics) can also be evaluated.

The klotho proteins of the present disclosure may be evaluated using an animal (model) that has or exhibits a particular disorder or condition, such as an age-related or age-associated disorder or condition, a metabolic disorder or condition, etc. Such disorders and conditions can also provide a sensitized system in which the effect of the protein on physiology can be observed. Exemplary disorders include, for example, denervation, disuse atrophy, metabolic disorders (e.g., disorder of obese and/or diabetic animals such as db/db mouse, ob/ob mouse, etc.), cerebral disorders, liver ischemia or other liver disorders, cisplatin/taxol/vincristine models, various tissue (xenograft) transplants, transgenic bone models, pain syndromes (e.g., inflammatory and neuropathic disorders), Paraquat, genotoxic, oxidative stress models, and tumor (I) models.

To evaluate the S-Klotho protein of the present disclosure, the protein can be administered to a suitable animal (for a suitable treatment period) and the parameter of the animal is evaluated (e.g., after a suitable period of time, such as 10 to 60 minutes, 1 to 24 hours, 1 to 30 days, 1 to 12 months, 1 to 5 years, or any value or range of values therebetween. The animal can be fed ad libitum or normally (e.g., not under caloric restriction, although some parameters can be evaluated under such conditions). Typically, a cohort of such animals is used for the assay. Generally, a test polypeptide can be indicated as favorably altering lifespan regulation in the animal if the test polypeptide affects the parameter in the direction of the phenotype of a similar animal subject to caloric restriction. Such test polypeptides may cause at least some of the lifespan regulatory effects of caloric restriction (e.g., a subset of such effects) without having to deprive the organism of caloric intake.

The parameter(s) to be tested may be age-associated or disease associated parameter(s) (e.g., a symptom of the disorder associated with the animal model). A test protein that is favorably indicated can cause an amelioration of the symptom relative to a similar reference animal not treated with the polypeptide. Other parameters relevant to a disorder or to aging can include: antioxidant levels (e.g. antioxidant enzyme levels or activity), stress resistance (e.g., paraquat resistance), core body temperature, glucose levels, insulin levels, thyroid-stimulating hormone levels, prolactin levels, and leutinizing hormone levels.

To measure the effectiveness of the S-Klotho protein of the present disclosure for treating an age-related disorder, an animal having decreased Klotho expression may be used (e.g., a mouse with a mutant or deleted klotho gene). For example, the test protein can be administered to the mutant mouse and age-related parameters are monitored. A test protein that is favorably indicated can cause an amelioration of the symptom relative to a similar reference animal not treated with the protein.

A parameter relevant to a metabolic disorder or to aging can be assessed by measurement of body weight, examination on the acquisition of reproductive ability, measurement of blood sugar level, observation of life span, observation of skin, observation of motor functions such as walking, and the like. The assessment can also be made by measurement of thymus weight, observation of the size of calcified nodules formed on the inner surface of thoracic cavity, and the like. Further, quantitative determination of mRNA for the klotho gene or the Klotho protein can also be useful for the assessment.

Still other (in vivo) models and organismal assays include evaluating an animal for a metabolic parameter, e.g., a parameter relevant to an insulin disorder, type II diabetes. Exemplary metabolic parameters include: glucose concentration, insulin concentration, and insulin sensitivity.

In assessing whether a test protein is capable of altering life span regulation, a number of age-associated parameters or biomarkers can be monitored or evaluated. Exemplary age associated parameters include: (i) lifespan of the cell or the organism; (ii) presence or abundance of a gene transcript or gene product in the cell or organism that has a biological age-dependent expression pattern; (iii) resistance of the cell or organism to stress; (iv) one or more metabolic parameters of the cell or organism (exemplary parameters include circulating insulin levels, blood glucose levels; fat content; core body temperature and so forth); (v) proliferative capacity of the cell or a set of cells present in the organism; and (vi) physical appearance or behavior of the cell or organism.

The term "average lifespan" refers to the average of the age of death of a cohort of organisms. In some cases, the "average lifespan" is assessed using a cohort of genetically identical organisms under controlled environmental conditions. Deaths due to mishap are discarded. Where average lifespan cannot be determined (e.g., for humans) under controlled environmental conditions, reliable statistical information (e.g., from actuarial tables) for a sufficiently large population can be used as the average lifespan.

Characterization of molecular differences between two such organisms, e.g., one reference organism and one organism treated with a S-Klotho protein can reveal a difference in the physiological state of the organisms. The reference organism and the treated organism are typically the same (or substantially the same) chronological age and/or sex. The term "chronological age" as used herein refers to time elapsed since a preselected event, such as conception, a defined embryological or fetal stage, or, more preferably, birth. A variety of criteria can be used to determine whether organisms are of the "same" chronological age for the comparative analysis.

Typically, the degree of accuracy required is a function of the average lifespan of a wildtype organism. For example, for the nematode *C. elegans*, for which the laboratory wildtype strain N2 lives an average of about 16 days under some controlled conditions, organisms of the same age may have lived for the same number of days. For mice, organism of the same age may have lived for the same number of weeks or months; for primates or humans, the same number of years (or within 2, 3, or 5 years); and so forth. Generally, organisms of the same chronological age may have lived for an amount of time within 15, 10, 5, 3, 2 or 1% of the average lifespan of a wildtype organism of that species. Preferably, the organisms are adult organisms (e.g., the organisms have lived for at least an amount of time in which the average wildtype organism has matured to an age at which it is competent to reproduce).

The organismal screening assay can be performed before the organisms exhibit overt physical features of aging. For example, the organisms may be adults that have lived only 10, 30, 40, 50, 60, or 70% of the average lifespan of a wildtype organism of the same species. Age-associated changes in metabolism, immune competence, and chromosomal structure have been reported. Any of these changes can be evaluated, either in a test subject (e.g., for an organism based assay), or prior, during or after treatment with a therapeutic described herein (e.g., for a (human, or mammal) patient).

A marker associated with caloric restriction can also be evaluated in a subject organism of a screening assay (or a treated subject). Although these markers may not be age-associated, they may be indicative of a physiological state that is altered when a Klotho or Klotho-related pathway is modulated. The marker can be an mRNA or protein whose abundance changes in calorically restricted animals. Cellular models derived from cells of an animal described herein or analogous to an animal model described herein can be used for a cell-based assay.

Models for evaluating the effect of a test protein on muscle atrophy include: 1) rat medial gastrocnemius muscle mass loss resulting from denervation, e.g., by severing the right sciatic nerve at mid-thigh; 2) rat medial gastrocnemius muscle mass loss resulting from immobilization (e.g., by fixed the right ankle joint at 90 degrees of flexion); 3) rat medial gastrocnemius muscle mass loss resulting from hind limb suspension; 4) skeletal muscle atrophy resulting from treatment with the cachectic cytokine, interleukin-1 (IL-1); and 5) skeletal muscle atrophy resulting from treatment with the glucocorticoid, dexamethasone.

Administration of Exogenous S-Klotho

The present disclosure relates to S-Klotho formulations, clinical dosages, and administration (e.g., to increase and/or maintain serum concentrations of S-Klotho within the range of a normal and/or young (e.g., 18-30 years of age) person (e.g., without any chronic conditions).

Aspects or embodiments of the present disclosure include, for example, administering a (cGMP- and/or clinical grade) human recombinant alpha soluble Klotho protein or protein fragment (of isoform 1) to a (human) subject in need thereof. Embodiments can also include measuring (in the (human) subject) serum S-Klotho levels or concentration (e.g., by Mass Spectroscopy (MS) or ELISA). Such measuring can occur before, after, and/or during S-Klotho administration, and can be repeated, as necessary, to determine serum S-Klotho levels and/or a rate of metabolism, degradation, or reduction of serum S-Klotho levels. MS is a technique well known in the art. MS can be used to identify and even quantify the level of one or more (native and/or recombinant) Klotho proteins in the serum of a subject.

One or more additional proteins can also be measured in the subject's serum. For instance, one or more Klotho-related and/or aging-related proteins (e.g., FGF21, GDF-11, TIMP2, NAD+, CCL11, hormones testosterone, estrogen, etc.) and/or kidney function proteins (e.g., KIM-1, Cystatin-C, creatinine, BUN, creatinine, NGAL, etc.) can be measured separate from or in combination with measuring Klotho in the serum.

In at least one embodiments, a serum sample is obtained, such as a blood sample. The sample can be obtained by a blood draw, as known in the art. In a preferred embodiment, a finger prick or other less invasive means of obtaining a blood sample can be used. Accordingly, blood samples can be taken more frequently (e.g., throughout the day and/or every 0.5, 1, 2, 3, 4, 5, 6, 7, 8, 9, 10, 11, or 12 hours). MS can be used to measure the total Klotho protein serum concentration, as well as the serum concentration of various alpha Klotho protein species, such as native Klotho species (e.g., soluble Klotho, cleaved Klotho, secreted Klotho, etc.) and/or one or more Klotho proteins of the present disclosure. In some embodiments, Klotho levels can be measured before therapeutic recombinant Klotho protein administration and again throughout the day and/or every 0.5, 1, 2, 3, 4, 5, 6, 7, 8, 9, 10, 11, or 12 hours post-administration.

Embodiments can also include determining such a rate and/or calculating a treatment protocol (e.g., including frequency, amount, and/or duration of (subsequent) administration(s) of S-Klotho) for maintaining within the serum of such subject a S-Klotho concentration within the range of a normal young person's sera concentration of S-Klotho. In at least one embodiment, the concentration of S-Klotho can be maintained at approximately 1000 picograms of (the S-Klotho) protein per milliliter of serum (pg/mL).

In at least one embodiment, a S-Klotho administration strategy (in humans) can include the measurement of one or more pharmacokinetic parameters of S-Klotho. For instance, measurements can be made of resultant changes in vivo of S-Klotho levels in the sera, urine and cerebrospinal fluid in response to S-Klotho administration. Some embodiments can include measuring the effectiveness of S-Klotho administration on one or more clinical indicators. Clinical indicators for various conditions, diseases, and disorders are known in the art and described further herein.

Embodiments can also include taking a (baseline)S-Klotho level measurement(s) (e.g., at zero time (before any administration of exogenous S-Klotho) and/or at different times of day before and/or throughout the treatment protocol (e.g., before and after administration of S-Klotho) in order to account for any circadian rhythm effects in the (human) subject(s)).

Embodiments can also include determining a suitable frequency, amount, and/or duration of S-Klotho administration. For instance, subjects with low S-Klotho serum levels (e.g., as determined by MS or ELISA immunoassay quantification), can be given (e.g., via any suitable route of administration) a first administration of klotho configured and/or adapted to bring the subjects serum S-Klotho levels to a first predetermined level (e.g., about 1000 pg/mL), measuring (the resultant change in) serum S-Klotho concentration in the subject (e.g., by MS or ELISA), measuring the levels and/or a rate of metabolism, degradation, or reduction of serum S-Klotho levels (following the first administration), calculating a half-life of the administered S-Klotho, and/or determining a frequency and/or timeframe in which a second, subsequent administration of S-Klotho should be given (e.g., in order to maintain serum S-Klotho levels above a second predetermined level). In at least one embodiment, the second predetermined level can be between and/or about 95%, 90%, 85%, 80%, 75%, 70%, 65%, 60%, 55%, 50%, 45%, 40%, 35%, 30%, 25%, 20%, 15%, 10%, and/or 5% of the first predetermined level.

Further administrations can be given over a timeframe suitable to produce in the subject (long-term)S-Klotho serum level equivalent to that of normal sex-matched young person's serum maintenance level (e.g., approximately 1000 pg/ml). The total timespan of the S-Klotho administration (to (human) subjects) can range from 1 day to 5 years, or more. Measurements and/or determinations of frailty in the subject based on the use of the clinical frailty score and other measurements can also be made over the timeframe.

Embodiments of the present disclosure further include increasing the S-Klotho dosage to maintain a 5%, 10%, 15%, 20%, 25%, 30%, 35%, 40%, 45%, 50%, 55%, 60%, 65%, 70%, 75%, 80%, 85%, 90%, 95%, 100% or more increase in S-Klotho levels above the normal range (e.g., at least about 500-1000 pg/ml serum, illustratively).

Certain embodiments include administering the S-Klotho protein. Non-limiting examples of suitable routes of administration include injection (e.g., bolus, gradual, intravenous, intradermal, intraperitoneal, intramuscular, intracutaneous, and/or subcutaneous injection), oral or oral-related administration (e.g., ingestion, buccal administration, and/or sublingual administration), topical administration, transdermal administration, rectal administration, vaginal administration, inhalation, and so forth.

An illustrative embodiment can include administering the S-Klotho protein or composition in a single bolus or extended (IV) injection (e.g., drip over an extended period of time). In at least one embodiment, 0.01, 0.05, 0.1, 0.5, 1, 1.5, 2, 2.5, 2.75, 3, 3.5, 4, 4.5, 5, 6, 7, 8, 9, 10, 12, 15, 18, 20, or more micrograms of S-Klotho per kilogram of subject body weight can be administered per treatment. A suitable administration amount can be calculated through one or more methods known in the art. One such method is the allometric scaling method. For example, in rat experiments, 0.01 mg of S-Klotho/kg body weight per administration was used, or 10 ug/kg. Using the human allometric scaled equivalent of 0.16, illustratively, the human equivalent dose (HED)=10 ug/kg×0.16=1.6 ug/kg. Hence a 70 kg human individual would require, 70 kg×1.6 ug/kg=112 ug and a 60 kg human would require, 60 kg×1.6=96 ug, illustratively. Table A, below, demonstrates conversion of various animal doses to human equivalent doses (HED) based on body surface area. The conversions assume a 60 kg human.

The HED was established using normalization to body surface area, a process described by Reagan-Shaw (2008), incorporated herein by reference. This process, termed allometric scaling, corrects for basal differences in metabolism rate between different species, and may be preferred over simple dose extrapolation. Illustratively, where the HED is 0.4 mg/kg, using allometric scaling, the human equivalent dose would be 0.4 mg/kg or 28 mg for an individual of 70 kg in weight, or 24 mg for an individual of 60 kg in weight. HED can illustratively be calculated with the equation: HED=animal dose in mg/kg×(animal weight in kg/human weight in kg).

TABLE A

| Species | To Convert Animal Dose in mg/kg to Dose in mg/m², Multiply by $k_m$ | To Convert Animal Dose in mg/kg to HED$^a$ in mg/kg, Either: | |
|---|---|---|---|
| | | Divide Animal Dose By | Multiply Animal Dose By |
| Human | 37 | — | — |
| Child (20 kg)$^b$ | 25 | — | — |
| Mouse | 3 | 12.3 | 0.08 |
| Hamster | 5 | 7.4 | 0.13 |
| Rat | 6 | 6.2 | 0.16 |
| Ferret | 7 | 5.3 | 0.19 |
| Guinea pig | 8 | 4.6 | 0.22 |
| Rabbit | 12 | 3.1 | 0.32 |
| Dog | 20 | 1.8 | 0.54 |
| Primates: | | | |
| Monkeys$^c$ | 12 | 3.1 | 0.32 |
| Marmoset | 6 | 6.2 | 0.16 |
| Squirrel monkey | 7 | 5.3 | 0.19 |
| Baboon | 20 | 1.8 | 0.54 |
| Micro-pig | 27 | 1.4 | 0.72 |
| Mini-pig | 35 | 1.1 | 0.95 |

Multiple factors can be considered or taking in account in determining, measuring, and/or estimating the amount and/or bioavailability of S-Klotho in humans (before and/or after recombinant protein administration), the total amount and/or concentration of S-Klotho to be administered, and/or the serum level response (over time) after recombinant protein administration. Such factors can include, for example, composition of the diluent, route of administration, site of administration, distribution into the tissues and organs of the subject, metabolic or other rate of the subject, pharmacokinetics (PK), pharmacodynamics (PD), toxicology (Tox), and so forth.

In at least one embodiment, a (normal) concentration of S-Klotho (e.g., in a healthy, young (18-30 years old) human adult) can be approximately 1000 pg/ml in sera. A typical adult can have a blood volume of approximately 5 liters, with females generally having less blood volume than males. Approximately 55% of human blood can be comprised of serum. Thus, (5 liters of blood/adult)×(0.55 sera/liter blood)=2.75 liters (2750 ml) of sera/adult. Assuming no endogenous serum S-klotho, to achieve a final concentration of 1000 pg/ml in the total blood sera; 2750 ml×1000 pg/ml=2,750,000 pg (or 2750 ng, or 2.75 μg) exogenous S-Klotho administered per adult subject.

To increase soluble Klotho to 50% greater than typical healthy levels (e.g., to 1500 pg/ml serum), a dose of 4.125 micrograms/subject can be administered. To increase soluble Klotho to 100% greater than typical healthy levels (e.g., to 2000 pg/ml serum) a dose of 5.5 micrograms/subject can be administered, and so forth.

A pharmaceutically effective and/or sufficient amount of purified recombinant S-klotho protein can be administered so as to raise the serum soluble Klotho protein concentration of the subject to any suitable level, such as greater than, equal to, or between about 50, 100, 250, 500, 750, 1000, 1250, 1500, 1750, 2000, 2250, 2500, 2750, 3000, 3500, 4000, 4500, 5000, 5500, 6000, 6500, 7000, 7500, 8000, 8500, 9000, 9500, 10,000, 11,000, 12,000, 13,000, 14,000, 15,000 20,000, 25,000, 30,000 40,000, 50,000, 75,000, 100,000 or more picograms of soluble Klotho protein per milliliter of serum, or greater than, equal to, or between about 5%, 10%, 15%, 20%, 25%, 30%, 40%, 50%, 60%, 70%, 80%, 90%, 100%, 150%, 200%, 250%, 300%, 400%, 500%, 600%, 700%, 800%, 900%, 1000%, 1200%, 1500%, 2000%, 2500%, 3000%, 4000%, 5000%, or more greater than typical healthy levels of soluble Klotho protein in serum.

In some embodiments, subjects can be administered one or more (bolus) intravenous, intradermal, intraperitoneal, intramuscular, intracutaneous, subcutaneous, and/or other injection of recombinant human S-Klotho protein at a dosage of greater than, equal to, or between about 0.01 mg/kg body weight in a suitable volume of Klotho buffer (e.g., 150 mM NaCl and 10 mM HEPES pH 7.4) or other pharmaceutically acceptable carrier. Thus, a 160 pound subject (i.e., body weight of 72.57 kg) can be administered a (bolus) injection of about 0.73 mg of S-Klotho per administration (based on the calculation of 0.01 mg of S-Klotho/kg×72.57 kg body weight). Likewise, a 170 pound person can receive a 0.77 mg of S-Klotho per administration. The total number and frequency of administrations can be determined based on achieving and maintaining in sera, a concentration of, for example, 1000 pg/ml of S-Klotho (equivalent to 0.000001 mg/ml sera). The latter can be ascertained as measured by MS or by a human S-Klotho ELISA assay.

In other embodiments, the dosage can be greater than, equal to, or between about 0.0001-10 mg/kg body weight, 0.0001-10 µg/kg body weight, 0.0001-10 ng/kg body weight, 0.0001-10 pg/kg body weight, or any value or range of values therebetween. Urine and/or blood can be collected at one or more time points, such as greater than, less than, equal to, between, and/or about 5 minutes, 10 minutes, 15 minutes, 20 minutes, 25 minutes, 30 minutes, 40 minutes, 45 minutes, 60 minutes, 90 minutes, 2 hours, 3 hours, 4 hours, 5 hours, 6 hours, 9 hours, 12 hours, 18 hours, 24 hours, 36 hours, 48 hours, 2.5 days, 3 days, 5 days, 7 days, 10 days, 14 days, 21 days, 4 weeks, 1 month, 2 months, 3 months, or more after a medical procedure or a first administration (dose) of recombinant Klotho protein (e.g., to measure, test, and/or determine serum S-Klotho levels and changes in response to administration and/or over time).

One or more embodiments include production and/or (subsequent) administration of a unique formulation of the S-Klotho active drug product and/or in combination with a pharmaceutically-acceptable carrier. The carrier can be suitable for IV and/or bolus injection. Embodiments can also include production and/or (subsequent) administration of a unique inactive prodrug formulation of the S-Klotho and/or in combination with a pharmaceutically-acceptable carrier (so that an inactive S-Klotho can be activated in vivo to release biologically effective S-Klotho in animals or in human subjects. Such prodrug formulation can include a coating or time-release formulation.

Administration of Exogenous S-Klotho to Treat Age-Related Frailty in Humans

An exemplary embodiment of the present disclosure relates to the administration of exogenous Klotho protein to treat age-related frailty (e.g., in humans or non-human animals). S-Klotho may rescue myogenic stem cells, improve muscle repair, and/or suppress fibrosis in animal models of human disease. S-Klotho may, therefore, be a promising therapeutic agent to counter muscle degeneration in aging human subjects showing signs of frailty.

For instance, the present disclosure relates to S-Klotho formulations, clinical dosages, and administration to a fragile and/or elderly (e.g., 60-95 years of age) person in order to maintain in the former subject a maintenance sera concentration of S-Klotho within the range of a normal and/or young (e.g., 18-30 years of age) person (e.g., without any chronic conditions).

Klotho treatment over an extended period of time can recover and/or improve one or more aging-related indicator or conditions in the elderly, frail, or otherwise physiologically aging.

Administration of Exogenous S-Klotho to Treat (Decrease) Muscle Atrophy in Humans An exemplary embodiment of the present disclosure relates to the administration of exogenous Klotho protein to treat (e.g., decrease (the rate of)) muscle atrophy in human as measured by skeletal muscle tissue mass and the concurrent use of the above protein and molecular indicators to provide guidance on the effects of Klotho administration in countering muscle atrophy.

Muscle atrophy can include numerous neuromuscular, metabolic, immunological and neurological disorders and diseases as well as starvation, nutritional deficiency, metabolic stress, diabetes, aging, muscular dystrophy, or myopathy. Muscle atrophy can occur during the aging process. Muscle atrophy can also result from reduced use or disuse of the muscle. Symptoms include a decline in skeletal muscle tissue mass. In human males, muscle mass declines by one-third between the ages of 50 and 80. Some molecular features of muscle atrophy can include the upregulation of ubiquitin ligases, and the loss of myofibrillar proteins. The breakdown of these proteins, which can be monitored (e.g., by measuring 3-methyl-histidine production, which is a specific constituent of actin), for example, in certain muscles of myosin. Release of creatine kinase (a cell damage marker) can also be indicative.

Administration of Exogenous S-Klotho to Treat Mental and/or Cognitive Decline in Old Age and/or Throughout the Human Lifespan An exemplary embodiment of the present disclosure relates to the administration of exogenous Klotho protein to improve and/or counteract (aging-related) decline in cognitive function(s). At the time of the present disclosure, it was unknown whether administration of exogenous Klotho proteins may counteract cognitive decline in humans. However, transgenic mice with systemic over-expression of klotho performed better than controls in multiple tests of learning and memory. Elevating klotho in mice also enhanced long-term potentiation, a form of synaptic plasticity, and enriched synaptic GluN2B, an N-methyl-D-aspartate receptor (NMDAR) subunit with key functions in learning and memory. Blockade of GluN2B abolished klotho-mediated effects.

Klotho-regulated pathways may be relevant to slowing the progression of Alzheimer's disease and other forms of dementia. Brain scans of more than 400 healthy men and women aged 53 and over found that those who carried a single copy of a particular Klotho gene variant had a larger brain region that deals with planning and decision making.

Further tests on the group found that those with an enlarged right dorsolateral prefrontal cortex (rDLPFC) fared better on a series of mental tasks.

About one in five people inherits a single copy of the gene variant, or allele, known as KL-VS, which improves heart and kidney function, and on average adds about three years to human lifespan. However as to the brain function, having a larger rDLPFC accounted for only 12% of the improvement in people's mental test scores while, on the other hand, as the editorial points out, carrying one copy of the KL-VS allele appears to confer a decade of resilience against the expected decline in structure and function of the rDLPFC. Thus, KL-VS heterozygosity appears to be associated with greater volume in right dorsolateral prefrontal cortex (rDLPFC).

Because rDLPFC is important for executive function, the investigators also analyzed working memory and processing speed in individuals. KL-VS heterozygosity may be associated with enhanced executive function across the lifespan examined. In short, results may suggest that variation in the klotho gene may be associated with bigger brain volume and better function.

An exemplary embodiment of the present disclosure relates to the administration of exogenous Klotho protein to augment in vivo klotho levels and/or (cellular, molecular, and/or downstream) effects (e.g., in order to enhance cognition and counteract cognitive deficits throughout the human lifespan). Exogenous administration of clinical grade S-Klotho preserves and/or improves cognitive function (e.g., in humans).

Administration of Exogenous S-Klotho to Treat (Prolong) Human Longevity and/or Lifespan An exemplary embodiment of the present disclosure relates to the administration of exogenous Klotho protein to chronological (e.g., age-matched from birth) and sex-matched human subjects to improve average lifespan. The results on average lifespan obtained with Klotho administration (the experimental group of human subjects) can be compared reliably to those individuals not receiving Klotho exogenous administration (the control group) and/or with statistical information (e.g., from actuarial tables) for a sufficiently large human population.

Administration of Exogenous S-Klotho to Treat Other Clinical Indications

An exemplary embodiment of the present disclosure relates to the administration of exogenous S-Klotho to treat any age-associated or otherwise non-age associated condition, including, but not limited to (increase in) human frailty, (decrease in) longevity, (decrease in) cellular senescence, (decline in) muscle strength, (decrease in) bone loss or density, (decrease in) cognition, (decline in) muscle mass, (decline in) physical fitness, (decline in) hand strength, (decline in) leg strength, and so forth. The present disclosure also relates to the administration of S-Klotho to increase bone mineral density (BMD) (e.g., in women but not in men), to increase BMD (e.g., in elderly women), which is reduced after menopause, to regenerate or reduce the degeneration of (degenerative) skeletal muscle, to improve walking gait, to improve (or reduce the decline in) spatial learning and memory, movement, freedom of movement, quality of life assessment, ejection fraction, exercise change, exercise improvement, and so forth. The present disclosure further relates to the administration of S-Klotho to decrease cognitive deterioration or forgetfulness, to increase cognitive capacity, to improve cognitive function and synaptic plasticity, to decrease a decline in learning, learning capacity or IQ, to improve learning, learning capacity or IQ, and so forth.

Administration of Exogenous S-Klotho to Treat Genetic Defects

An exemplary embodiment of the present disclosure relates to the administration of exogenous S-Klotho to treat (e.g., correct) known human genetic defects. For example, a 13-year-old girl with familial tumoral calcinosis and a Klotho mutation has been reported. Familial tumoral calcinosis is an autosomal recessive metabolic disease characterized by ectopic calcifications and hyperphosphatemia due to inactivating mutations in FGF23 or GALNT3. FGF23 is a hormone necessary for the renal excretion of phosphate, while GALNT is an enzyme contributing to the maturation and secretion of FGF23. A homozygous mutation in the KLOTHO gene has been identified in the 13-year old girl. KLOTHO encodes a secreted protein necessary to the transmission of the signal emitted by FGF23 toward its receptors. The administration of exogenous human recombinant S-Klotho constitutes a highly targeted and effective therapy to address the malfunction and symptoms associated with familial tumoral calcinosis.

Administration of Exogenous S-Klotho to Treat Acute Kidney Injury (AKI)

Acute kidney injury (AKI), previously called acute renal failure (ARF), is often defined as an abrupt onset of renal dysfunction ranging from minor loss of function to failure. AKI is a common clinical complication that develops in approximately 4%-7% of hospitalized patients each year and the prognosis can be poor. Mortality rates associated with AKI range from 5%-35%. Renal Klotho expression has been shown to be suppressed following AKI. Adenoviral gene transfer of Klotho can be cytoprotective in AKI.

Acute Kidney Injury (AKI) has been report in approximately 4.9%-7% of hospitalized patients each year. The rate of AKI may be as high as 60% in (hospitalized) elderly persons and 20-30% in elderly or critically ill patients. AKI is also associated with increased mortality, length of stay (LOS), 30 day re-administration rates and hospital cost.

AKI may result at least in part from kidney transplant or other surgery, acute tubular necrosis (ATN), acute allergic interstitial nephritis (AAIN), nephritis (e.g., glomerulonephritis), nephrotoxicity (e.g., drug-induced nephrotoxicity), low blood pressure, sepsis or septic condition, or other contributing factor(s). Kidney transplant and other surgeries can cause acute damage or injury to the kidneys, cause renal disease and/or failure. Nephrotoxicity can contribute to AKI, ATN, AAIN, nephritis, etc. It has been reported that drugs (e.g., clinically-administered, prescription, illegal, or other drugs) are associated with 15% to 25% of all cases of AKI. Contrast media alone accounts for 10% of all causes of hospital-acquired acute renal failure (e.g., via contrast-induced acute kidney injury CIAKI) and represents the third leading cause of in-hospital renal function deterioration after decreased renal perfusion and postoperative renal insufficiency.

In some cases, drug-induced AKI can be or comprise anti-microbial-induced nephrotoxicity (resulting from anti-microbial treatment). For instance, certain (gram-negative) bacterial infections can be treated with one or more aminoglycosides, such as paromomycin, tobramycin, gentamicin, amikacin, kanamycin, neomycin, and so forth. Aminoglycosides have been shown to be nephrotoxic. Table 1 presents treatment data collected on the adult patients receiving the aminoglycosides. As illustrated in Table 1, nearly 23% of patients treated with amikacin, a common aminoglycoside, developed acute kidney disease and over 17% of patients treated with amikacin dies prior to being discharged. Other aminoglycosides, including gentamicin, and tobramycin also induced (or were associated with or contributed to) kidney disease.

TABLE 1

|  | Amikacin | Gentamicin | Tobramycin | Aminoglycosides |
| --- | --- | --- | --- | --- |
| Length of Stay | 11.8 | 8.7 | 10.4 | 9.2 |
| Discharged Home | 55.1% | 72.0% | 62.6% | 68.9% |
| Died | 17.1% | 4.1% | 6.3% | 5.8% |
| ICU | 21.8% | 18.2% | 21.8% | 18.7% |
| Pedriatric Patient (<18 yrs.) | 0.0% | 21.6% | 6.1% | 16.5% |
| Nursing Home Patient | 22.1% | 12.5% | 20.2% | 14.6% |
| Kidney Disease | 22.9% | 13.5% | 16.5% | 14.8% |
| Top 5 Dx | UTI/cystitis | UTI/cystitis | Pneumonia | UTI/cystitis |
|  | Sepsis | Sepsis | UTI/cystitis | Sepsis |
|  | Pneumonia | Skin infection | Sepsis | Pneumonia |
|  | Skin Infection | Pneumonia | Skin Infection | Skin Infection |
|  | Pelvic infection | FUO | Pelvic Infection | Pelvic Infection |

Figure 3A:
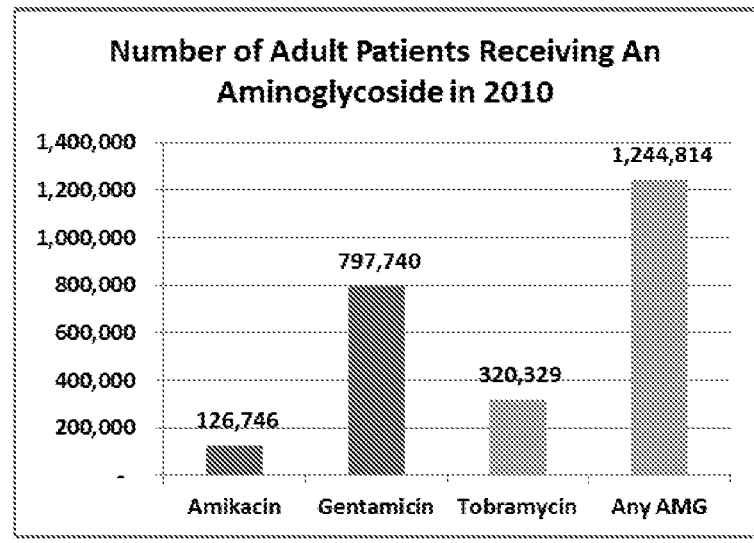
FIG. 3A illustrates the number of adult patients receiving certain aminoglycosides in the year 2010.
Figure 3B:
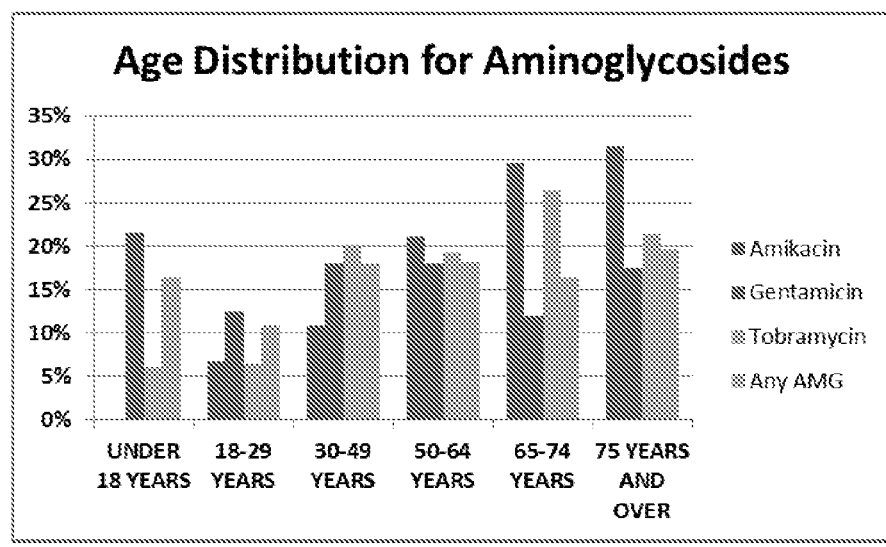
FIG. 3B illustrates the age distribution of the adult patients receiving the aminoglycosides presented in FIG. 3A.
Figure 7:
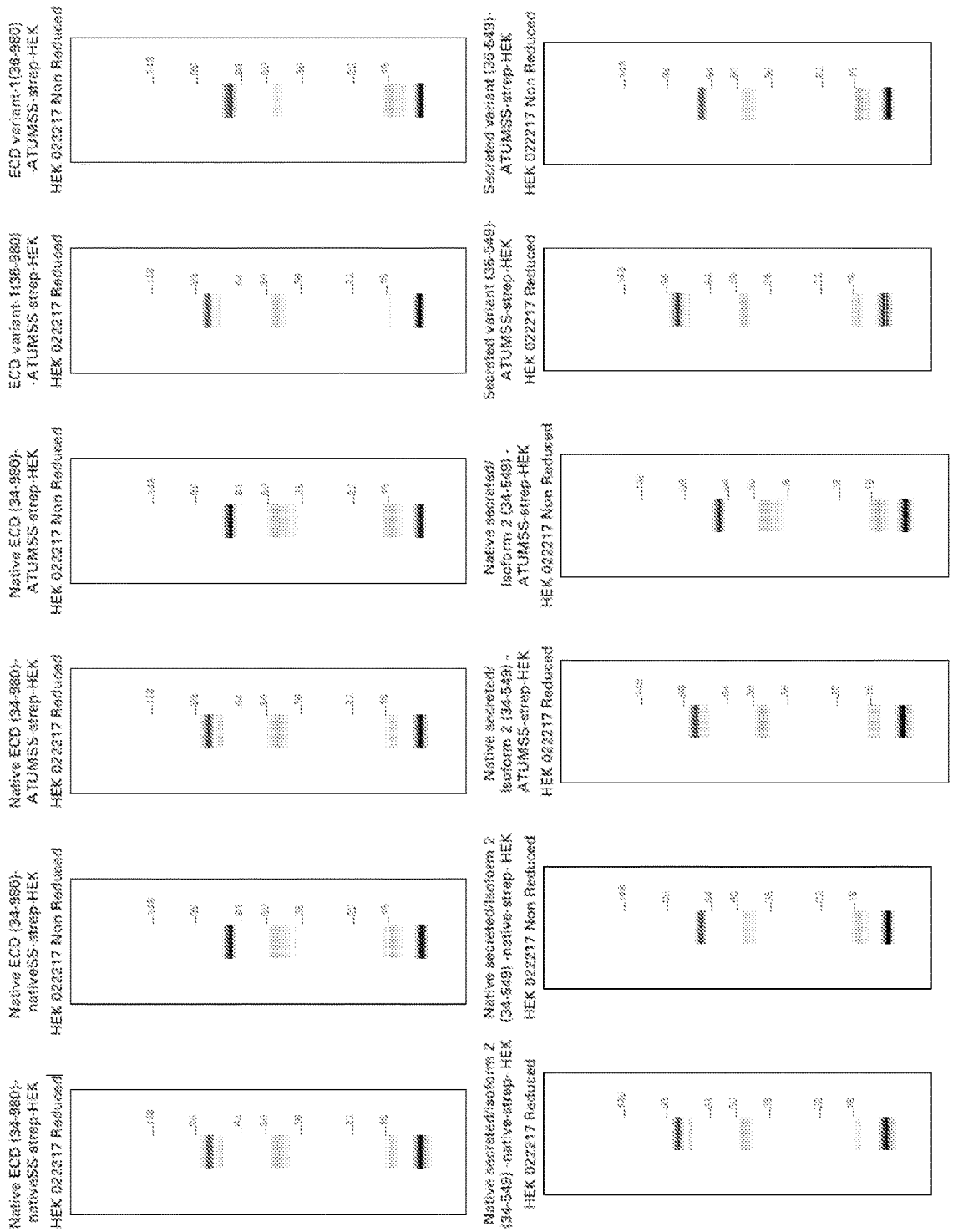
FIG. 7 is a series of gels for the respective indicated recombinant Klotho protein constructs.
Figure 8A:
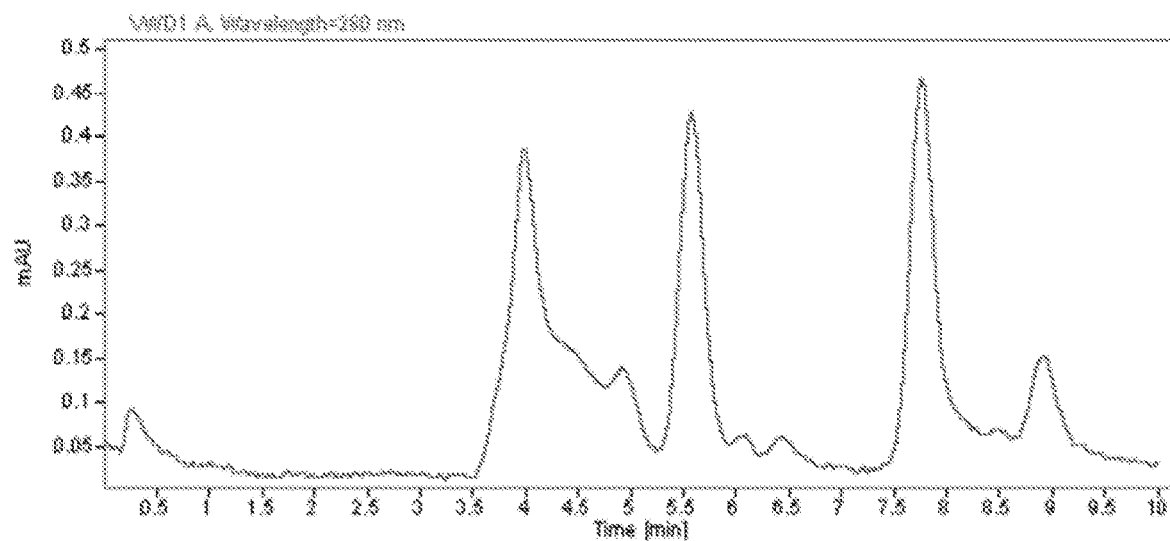
FIGS. 8A-8G are a series of HPLC chromatographs for the respective indicated recombinant Klotho protein constructs.
Figure 8B:
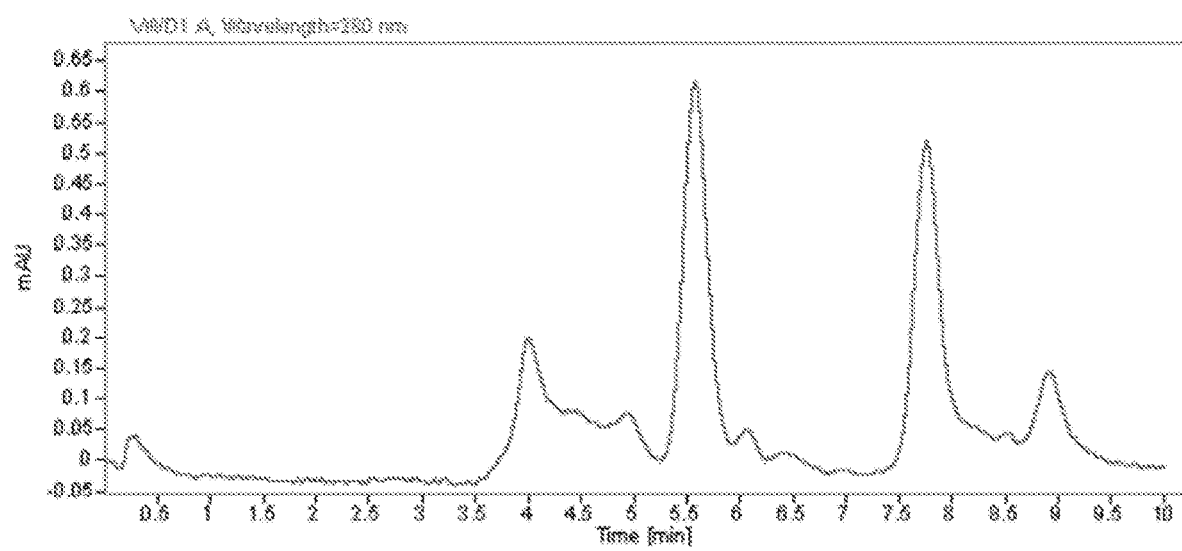
Figure 8C:
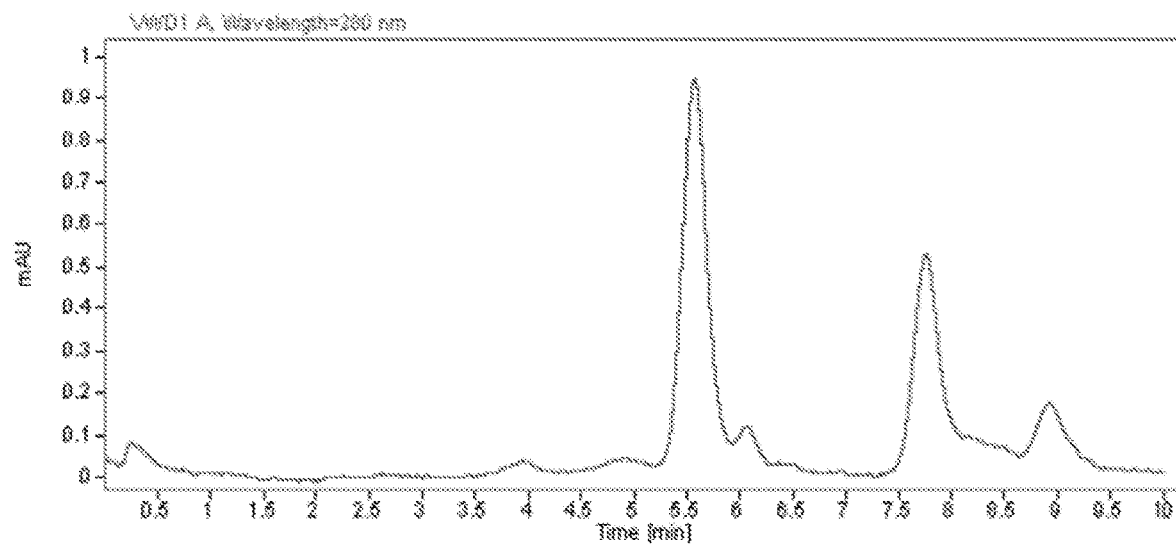
Figure 8D:
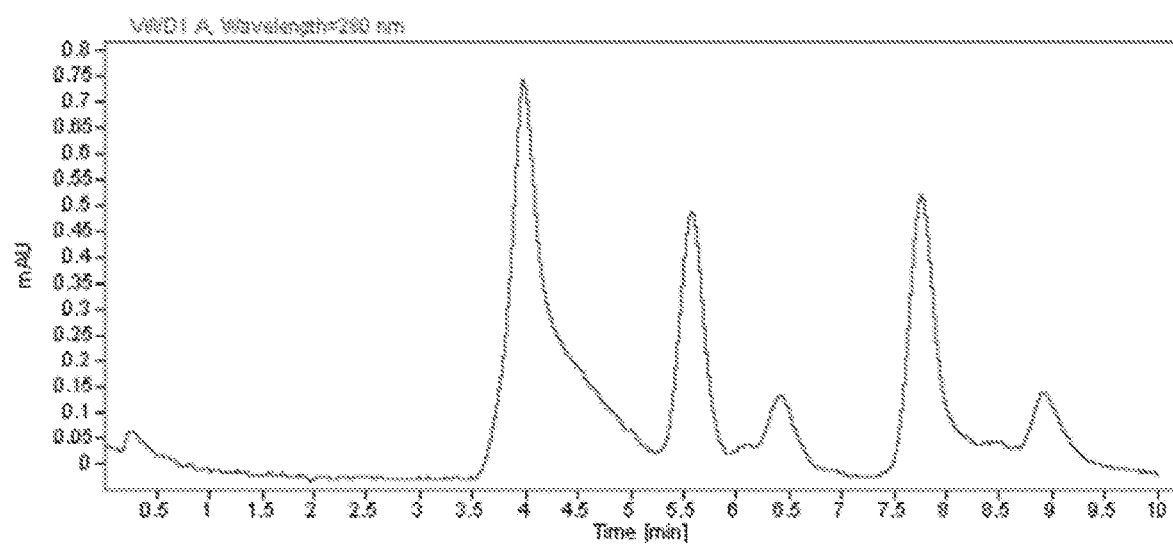
Figure 8E:
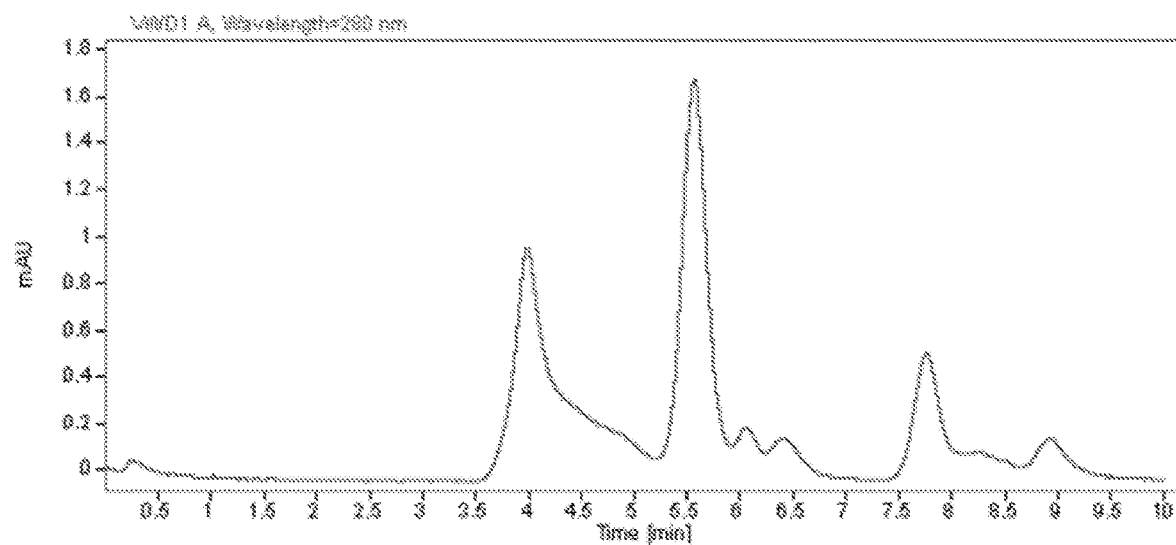
Figure 8F:
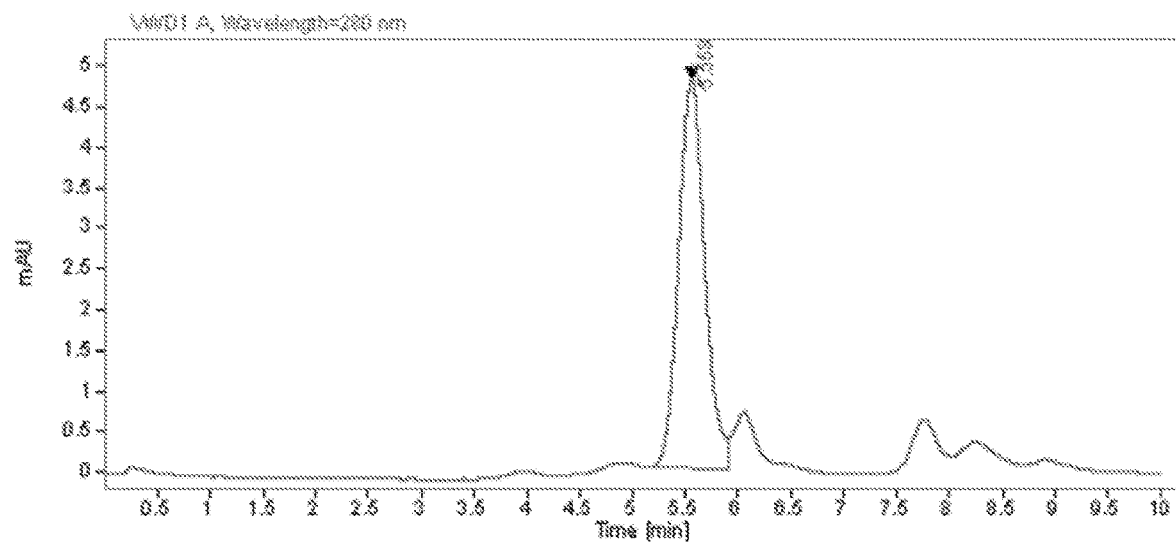
Figure 8G:
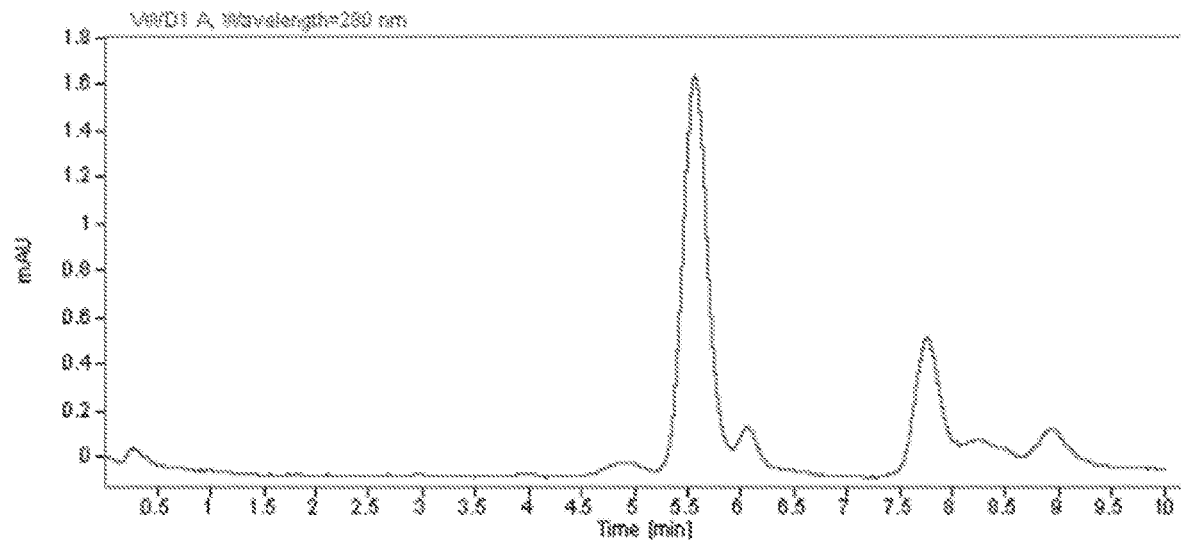

As illustrated in FIGS. 3A and 3B, over 1.2 million adult patients, in various age groups, were treated with aminoglycosides in the year 2010. Other anti-microbial agents include, for example, penicillins, ampicillin, cephalosporins, sulfonamides, ciprofloxacin, vancomycin, macrolides, tetracyclines, rifampin, and so forth.

Drug-induced nephrotoxicity can also result from treatment with one or more non-steroid anti-inflammatory drugs (NSAIDs), such as aspirin (acetylsalicylic acid), celecoxib, diclofenac, diflunisal, etodolac, ibuprofen, indomethacin, ketoprofen, ketorolac, nabumetone, naproxen, oxaprozin, piroxicam, salsalate, sulindac, tolmetin, and so forth.

Drug-induced nephrotoxicity can also result from treatment with one or more cyclooxygenase-2 (COX-2) inhibitors (e.g., valdecoxib, rofecoxib, celecoxib, etc.), proton pump inhibitors (e.g., omeprazole, lansoprazole, etc.), anticonvulsants (e.g., phenytoin, valproic acid, etc.), histamine H2 receptor antagonist (e.g., nizatidine, ranitidine, famotidine, cimetidine, etc.), diuretics (e.g., carbonic anhydrase inhibitors, loop diuretics (e.g., bumetanide, ethacrynic acid, torsemide, furosemide, etc.), potassium-sparing diuretics (e.g., triamterene, spironolactone, amiloride, etc.), thiazide diuretics (e.g., indapamide, chlorthalidone, metolazone, methyclothiazide, hydrochlorothiazide, chlorothiazide, bendroflumethiazide, polythiazide, hydroflumethiazide, etc.), or other diuretics, such as pamabrom, mannitol, and so forth.

Drug-induced nephrotoxicity can also result from treatment with lithium, which can affect the flow of sodium through nerve and muscle cells in the body and can be used to treat manic episodes of bipolar disorder, often characterized by hyperactivity, rushed speech, poor judgment, reduced need for sleep, aggression, and anger. Lithium can also help to prevent or lessen the intensity of manic episodes. Drug-induced nephrotoxicity can also result from treatment with or exposure to gold, mercury, copper, or other elemental matter.

Drug-induced nephrotoxicity can also result from treatment with (D-) penicillamine; a medication of the chelator class, which can be used to treat scleroderma, Wilson's disease (by binding to accumulated copper for elimination through urine), cystinuria (by binding with cysteine to yield a mixed disulfide which is more soluble than cysteine), direct-acting smooth muscle relaxant (e.g., hydralazine), spasmolytics (e.g., carisoprodol, cyclobenzaprine, metaxalone, methocarbamol, benzodiazepines, such as diazepam, clonidine and other imidazoline compounds, tizanidine, baclofen, hydantoin derivatives, dantrolene, and so forth.

Other forms of drug-induced nephrotoxicity can include, for example: contrast-induced nephrotoxicity (e.g., following exposure to (iodinated) contrast media, also known as radiocontrast-induced nephropathy (CIN)); narcotic- (opioid-) induced nephrotoxicity (e.g., following use or abuse of certain narcotics (e.g., opioids), such as cocaine, heroin, etc.); chemotherapy-induced nephrotoxicity (e.g., following treatment with a cancer therapeutic, such as: cisplatin; carboplatin; oxaliplatin; alkylating agents, such as bendamustine, cyclophosphamide, ifosfamide, nitrosoureas, temozolomide, melphalan, etc.; antitumor antibiotics, such as mitomycin C, bleomycin, anthracyclines and related agents, etc.; antimetabolites, such as capecitabine, hydroxyurea, methotrexate, pemetrexed, pralatrexate, pentostatin, fludarabine, cladribine, gemcitabine, cytarabine, etc.; vinca alkaloids; topotecan; etoposide; taxanes; irinotecan; lenalidomide; eribulin; arsenic trioxide; ixazomib; etc.); and so forth. Indeed, a wide variety of nephrotoxic drugs can induce nephrotoxicity, leading to AKI. Drug-induced nephrotoxicity (and other forms of AKI) can be life-threatening if untreated and can incur enormous costs (to patients, hospitals, and insurers) to treat.

Embodiments of the present disclosure can include a method of treating or preventing (e.g., prophylactically or in response to at least on event) acute kidney injury (AKI), chronic kidney disease (CKD), or other condition. The method can comprise administering a recombinant (soluble) Klotho protein to a subject in need thereof. For instance, the method can comprise administering to a subject in need thereof, a pharmaceutically-effective amount of a recombinant soluble Klotho protein having at least 80% amino acid sequence identity to one of SEQ ID NO: 2 through SEQ ID NO: 70 or SEQ ID NO: 107 through SEQ ID NO: 120 (e.g., so as to raise and/or maintain a serum soluble Klotho protein concentration of the subject at or above a predetermined threshold for a predetermined period of time). The condition can comprise: (i) acute tubular necrosis (ATN), acute allergic interstitial nephritis (AAIN), nephritis, glomerulonephritis, and/or nephrotoxicity; or (ii) AKI resulting at least in part from sepsis, kidney transplant or other surgery or medical procedure, acute tubular necrosis (ATN), acute allergic interstitial nephritis (AAIN), nephritis, glomerulonephritis, nephrotoxicity, or low blood pressure. The condition can comprise a drug-induced (e.g., aminoglycosides-induced) nephrotoxicity. The protein can be administered prophylactically, for example, prior to kidney transplant, nephrotoxin administration, or other activity, treatment, or event known or anticipated to cause or contribute to AKI. Alternatively, or in addition, the protein can be administered in response to AKI, such as after kidney transplant or other surgery, aminoglycoside or other nephrotoxin administration, or other activity, treatment, or event known or anticipated to cause or contribute to AKI.

In some embodiments, the nephrotoxin or other drug can be or comprise, for example: one or more aminoglycosides (e.g., paromomycin, tobramycin, gentamicin, amikacin, kanamycin, neomycin, etc.); one or more anti-fungal agents (e.g., amphotericin B, flucytosine, etc.); one or more contrast agents (e.g., (iodinated) radiocontrast media, high-osmolality contrast media (HOCM) having an iodine to molecule ratio of about 1.5:1, low-osmolality, nonionic contrast media (LOCM) having an iodine to molecule ratio of about 3:1, isosmolar (isoosmolality) contrast media (IOCM) having an iodine to molecule ratio of about 6:1, etc.); one or more antiretroviral agents (e.g., adefovir, cidofovir, tenofovir, foscarnet, etc.); one or more cancer (or chemo-) therapeutics (e.g., cisplatin, carboplatin, oxaliplatin, alkylating agents (such as bendamustine, cyclophosphamide, ifosfamide, nitrosoureas, temozolomide, melphalan, etc.), antitumor antibiotics (such as mitomycin C, bleomycin, anthracyclines and related agents, etc.), antimetabolites (such as capecitabine, hydroxyurea, methotrexate, pemetrexed, pralatrexate, pentostatin, fludarabine, cladribine, gemcitabine, cytarabine, etc.), *vinca* alkaloids, topotecan, etoposide, taxanes, irinotecan, lenalidomide, eribulin, arsenic trioxide, ixazomib, etc.); one or more bisphosphonates, or derivatives thereof (e.g., zoledronate/zoledronic acid, ibandronate, alendronate, alendronate/cholecalciferol, etidronate, risedronate (optionally, with calcium carbonate), pamidronate, tiludronate, etc.); and/or one or more narcotics (e.g., opioids), such as cocaine, heroin, etc.);

Embodiments of the present disclosure can include a method of administering a therapeutic recombinant (alpha soluble) Klotho protein (e.g., with at least 80% amino acid sequence identity to amino acid residues 1-981, or a subset thereof, of human alpha Klotho isoform 1). The method can include administering the therapeutic Klotho protein to a human or non-human subject to treat or prevent (prophylactically) AKI or one or more conditions associated with AKI. The method can include determining a level of serum soluble klotho level in the subject, calculating a first dosage of protein sufficient to raise the serum soluble klotho level in the subject to a predetermined level or percent of normal levels, administering the first dosage of protein to the subject, such as by bolus or gradual administration, determining a rate of soluble Klotho decline in the serum of the subject, such as following administration of the first dosage, calculating a subsequent dosage time and amount, and/or administering the subsequent dosage of protein to the subject.

Administration of Exogenous S-Klotho to Treat Chronic Kidney Disease (CKD)

As described in Neyra and Hu, Potential application of klotho in human chronic kidney disease, *Bone* (2017), which is incorporated herein by reference in its entirety, soluble Klotho in the circulation starts to decline early in chronic kidney disease (CKD) stage 2 and urinary Klotho possibly even earlier in CKD stage 1. Therefore, soluble Klotho could serve as an early and sensitive marker of kidney function decline. Moreover, preclinical animal data support Klotho deficiency is not just merely a biomarker, but a pathogenic factor for CKD progression and extrarenal CKD complications including cardiovascular disease and disturbed mineral metabolism. Prevention of Klotho decline, re-activation of endogenous Klotho production or supplementation of exogenous Klotho are all associated with attenuation of renal fibrosis, retardation of CKD progression, improvement of mineralmetabolism, amelioration of cardiomyopathy, and alleviation of vascular calcification in CKD in animal models.

CKD is characterized by progressive deterioration of renal function with high risk of ESRD. CKD risk increases with age, and about half of the CKD stage ≥3 cases occurs in subjects > or =70 years old. CKD can be viewed as a state of accelerated aging. The relative risk for cardiovascular mortality of a 25 to 34-year-old dialysis patient is similar to a non-CKD patient of > or =75 years of age. Cardiovascular disease is the principal killer in CKD and ESRD patients. CKD and ESRD patients have low renal Klotho expression and low levels of circulating Klotho. Renal Klotho deficiency in early stages of CKD may be attributed mainly to suppression of Klotho expression rather than loss of viable renal tubules. Furthermore, some dialysis patients still have detectable circulating Klotho, suggesting that renal Klotho expression is not completely suppressed, and Klotho may come from extra-renal source(s), although its origin is not clear to date. Establishing extra-renal sources of Klotho and characterizing how this can be up-regulated when renal production fails is of paramount importance.

Administration of exogenous Klotho proteins of the present disclosure can help to prevent, retard, and decrease the burden of comorbidity in CKD.

Compositions and Treatments Including S-Klotho in Combination with Other Component(s)

Klotho can also act in an additive or synergistic matter with other compounds and/or components to influence one or more aspects of human health and well-being. For instance, treatments that include a therapeutic human recombinant soluble alpha Klotho (S-Klotho) protein in combination and/or concurrently with one or more additional active components can benefit human patients. Such treatments can be prophylactic or responsive to any human condition on which the Klotho protein and/or other component(s) can have a therapeutic effect. Such conditions can include, for example, an age-related condition, a metabolic condition, a chronic or acute condition, and so forth. Specific, non-limiting examples of specific conditions are disclosed herein.

S-klotho may exist in the human body along with other blood borne anti-aging compound such as growth/differentiation factor 11 (GDF-11). Accordingly, in certain embodiments, therapeutic S-klotho can be co-administered (e.g., concurrently, sequentially, and/or in combination) with therapeutic GDF-11. Such administration can have additive or synergistic anti-aging or other effects in some embodiments. Likewise the co-administration S-klotho to human subjects with (neutralizing) antibodies to or suppressor of CCL11 may work in unison to counter aging or other condition (as CCL11 (also known as eotaxin-1) is understood to be a negative regulator of stem cell rejuvenation). S-klotho can also or alternatively be co-administered with other eotaxins, such as eotaxin-2 (CCL24) and/or eotaxin-3 (CCL26).

In some embodiments, S-klotho can be co-administered with suppressors of or antibodies to Transforming Growth Factor (β-1 (TGF-β1). S-klotho administration may oppose the action of the TGF-β1 signal pathways involved in an endogenous anti-cellular epithelial-to-mesenchymal transition (anti-EMT) that leads to renal and other tissue fibrosis). Anti-EMT is also relevant in cancer cells where inhibiting EMT may confer on cancer cells the ability to metastasize—this latter process is understood to be opposed by klotho. Accordingly, co-administration of S-klotho and a suppressor of or antibody to Transforming Growth Factor β-1 (TGF-β1) can have synergistic or additive effects.

In some embodiments, S-klotho can be co-administered with antibodies to or suppressors of Insulin Growth Factor-1 (IGF-1). Klotho is understood to be a hormone that inhibits the intracellular insulin/IGF-1 signaling cascade, and this inhibition increases resistance to oxidative stress at the cellular and organismal level in mammals; a mechanism which is considered to be evolutionarily conserved for extending life span. Accordingly, co-administration of S-klotho and a suppressor of or antibody to Insulin Growth Factor-1 (IGF-1) can have synergistic or additive effects.

In some embodiments, S-klotho can be administered in combinations with vitamin D (e.g., Vitamin D3) or 1,25-dihydroxyvitamin $D_3$ [1,25(OH)$_2$D$_3$], FGF-15, FGF-19, and/or Klotho (3; since numerous studies have revealed a comprehensive regulatory scheme of mineral homeostasis involving the mutually regulated positive/negative feedback actions of Klotho α-K1, FGF23, and 1,25(OH)$_2$D and/or an analogous regulatory network composed of Klotho β-K1, FGF15/humanFGF19, and bile acids that regulate bile acid/cholesterol metabolism. Such co-administration can have synergistic or additive effects on numerous conditions and/or processes in the body. In some embodiments, S-klotho can be administered in combinations with FGF-21, In some embodiments, S-klotho can be co-administered with carbonic anhydrase inhibitors, such as acetazolamide, methazolamide, dichlorphenamide, dorzolamide, brinzolamide, and/or topiramate. Such combinatorial administration can be useful in the treatment of ankylosing spondylitis (AS), rheumatoid arthritis (RA), and a variety of other conditions. Various investigations have shown that increased bone resorption is a characteristic of AS and RA and that carbonic anhydrase inhibitors play an antiarthritic role by inhibiting bone resorption. At the bone level, through a different mechanism, S-klotho stimulates bone resorption and phosphate release by acting on TRPV5, which is a recently identified osteoclast function modulator. Increased levels of 1,25(OH)$_2$D$_3$ caused by S-Klotho administration can also stimulate osteoclast differentiation and bone resorption and, thereby, phosphate release. Thus, co-administration of S-Klotho and carbonic anhydrase inhibitors can have an additive or synergistic effect, especially in promoting bone health, particularly in AS and RA.

S-Klotho can be administered in combination with one or more disease-modifying antirheumatic drugs (DMARDs)—for the treatment of severe active rheumatoid arthritis.

S-Klotho can be administered in combination with cyclosporine, since cyclosporine decreasing klotho mRNA and protein and increases oxidative stress leading to cyclosporine induced-renal injury (CsA). The associated decrease of klotho mRNA and protein and increases oxidative stress can be countered by exogenous co-administration of S-Klotho.

In some embodiments, S-klotho can be co-administered with losartan and/or cyclosporine. Treatment with losartan, an angiotensin II type 1 (AT1) receptor blocker, reversed the decrease in klotho expression seen with cyclosporine. Losartan also produced a concurrent improvement in renal histology (with losartan decreasing the tubulointerstitial fibrosis that is caused by cyclosporine).

In some embodiments, S-klotho can be co-administered with one or more aminoglycosides, such as amikacin, gentamicin, tobramycin, etc. Such treatment can be useful to prevent nephrotoxicity and/or acute kidney injury (AKI) when aminoglycosides are used to treat (gram-negative) pathogen infection, which may greatly expand the use of aminoglycosides to treat infections. The administration of S-Klotho with verapamil and/or diltiazem, which have been used to block AKI, can be therapeutic in the treatment and/or prevention of renal dysfunction from AKI.

In some embodiments, S-klotho can be co-administered with testosterone or androgen receptor (AR) up-regulating compounds. Recent reports indicate no beneficial effect of testosterone treatment in men in regards to personality, psychological well-being, or mood is observed. In addition, the prescription of testosterone supplementation for low-T for cardiovascular health, sexual function, physical function, mood, or cognitive function was considered to be without support from randomized clinical trials. However, testosterone supplementation was consistently found to increase muscle strength but did not have beneficial effects on physical function. S-Klotho administration in combination with testosterone and/or androgen receptor (AR) up-regulating compounds can significantly increase muscle strength and/or physical function in elderly, frail, or low-T men beyond any effect that testosterone or S-Klotho may have alone in these treatment groups.

In some embodiments, S-klotho can be co-administered with estrogen or an estrogen hormone (e.g., estradiol, estriol, estrone, etc.). Such co-administration can improve health indicators in women (e.g., menstrual, menopausal, or menopausal transitioning women) and/or treat infertility, polycystic ovarian disease or disorder, obesity, hormone imbalance and related conditions, and/or other female health conditions.

In some embodiments, S-klotho can be co-administered with one or more nootropics—also called smart drugs or cognitive enhancers. Nootropics drugs, supplements, and/or other substances can improve cognitive function, particularly executive functions, memory, creativity, motivation, task saliency (motivation to perform a task), performance (especially on tedious tasks that require a high degree of effort), and can be useful in treating cognitive or motor function difficulties attributable to disorders such as Alzheimer's disease, Parkinson's disease, Huntington's disease, and ADHD. The most commonly used class of drug that is known to improve some aspect of cognition is stimulants, especially the classes of stimulants that demonstrate cognition-enhancing effects in humans by acting as direct agonists or indirect agonists of dopamine receptor D1, adrenoceptor A2, or both receptors in the prefrontal cortex. Stimulants include, for example: amphetamines (e.g., amphetamine, dextroamphetamine, lisdexamfetamine, etc.), which can benefit a range of cognitive functions (e.g., inhibitory control, episodic memory, working memory, and aspects of attention), especially in individuals with ADHD; dimethylamylamine (DMAA), such as 1,3-dimethylamylamine, which can improve physical performance, alertness, reaction time, etc.; methylphenidate—a substituted phenethylamine that can improve a range of cognitive functions (e.g., working memory, episodic memory, and inhibitory control, aspects of attention, and planning latency); eugeroics (e.g., armodafinil, modafinil, etc.), which can function as wakefulness promoting agents that can increase alertness, particularly in sleep deprived individuals, facilitate reasoning and problem solving, treat narcolepsy, shift work sleep disorder, and daytime sleepiness remaining after sleep apnea treatments, and so forth; xanthines (e.g., caffeine, etc.), which can increase alertness, performance, and/or memory; nicotine, and so forth.

In some embodiments, S-klotho can be co-administered with one or more osteoporosis and/or osteopenia medications, as known in the art. Klotho may play a role in regulating bone mineral density, as the absence of Klotho can lead to reduced bone mineral density in animals. For instance, Klotho knockout mice show reduced bone mineral density over time. Klotho expression can rescue bone defect, such as Klotho knockout mice show reduced bone mineral density over time, in Klotho knockout animals. Epidemiological studies have shown associations between various Klotho gene variants and changes in bone mineral density and prevalence of hand osteoarthritis.

S-Klotho can be administered in combination with one or more anti-cancer treatments and/or preventions, such as a chemotherapeutic. In lung cancers, such as non-small cell lung cancer (NSCLC), for example, S-klotho administration can affect the resistance of lung cancer cells to cisplatin and/or other chemotherapy. In addition, S-klotho can function as a potential tumor suppressor in lung cancer, gastric cancer, pancreatic cancer (adenocarcinoma), and other forms of cancer. S-Klotho can be administered in combination with sorafenib chemotherapy for the treatment of hepatocellular carcinoma (HCC). Overexpression of klotho as well as treatment with soluble klotho protein can reduce hepatoma cell growth in vitro and in vivo. Other cancer types that can be treated with S-klotho co-administration include hepatocellular carcinoma (HCC), central nervous system (CNS) cancers (e.g., brain (e.g., glioma, craniopharyngioma, medulloblastoma and meningioma), spinal cord, and other tumors, lymphoma, etc.), (metastatic) colon cancer, and so forth.

S-Klotho can also be administered in combination with chemotherapeutic to treat chemotherapy-induced frailty in cancer patients. S-Klotho can also be administered to treat cancer-induced frailty in cancer patients following other known treatments.

S-Klotho can be administered in combination with kidney dialysis or other procedures. S-Klotho can be administered to treat frailty in dialysis patients, as frailty is associated with poor outcomes for patients on dialysis.

S-Klotho can be administered in combination with one or more Alzheimer's Disease treatment or preventions, or with brain-derived neurotrophic factor (BDNF), as an adequate amount of BDNF can help to develop and maintain normal neuronal circuits in the brain.

S-Klotho can be administered in combination with one or more molecules that increase the ability of klotho to cross the blood—brain barrier in order to increase the ability of klotho to enter the central nervous system (CNS) in order to treat or prevent CNS-relates conditions. For example, neither S-Klotho nor BDNF are known to cross the blood-brain barrier. Embodiments of the present discloser include utilizing blood-brain barrier delivery techniques for the administration of S-klotho and/or S-klotho with BDNF to the CNS to treat Alzheimer's Disease and/or improve cognition in individuals not affected by Alzheimer's Disease.

S-Klotho can be administered in combination with 5' adenosine monophosphate-activated protein kinase (AMPK) or AMPK activating drugs or ingredients that positively regulates signaling pathways that replenish cellular ATP supplies, including fatty acid oxidation and autophagy; or that negatively regulates ATP-consuming biosynthetic processes including gluconeogenesis, lipid and protein synthesis.

S-Klotho can be administered in combination with one or more anti-diabetic drugs such as insulin, phloridzin or the antioxidant tiron and these combination treatments may have merit in the prevention of renal damage from oxidative stress produced in diabetic disorders. The co-administration of S-Klotho with other antidiabetic drugs for type 1 diabetes can protect β-cells by inhibiting β-cell apoptosis through activation of the integrin β1-FAK/Akt pathway, leading to inhibition of caspase 3 cleavage.

S-Klotho can be administered in combination with one or more type 2 anti-diabetes drugs such as metformin for improving glycemic control and vascular function in overweight and obese diabetic subjects.

S-Klotho can be administered in combination with one or more blood pressure medications, calcium regulators, or treatments or preventions of chronic kidney disease (CKD). For example, soft-tissue calcification is a prominent feature in CKD and Klotho can ameliorate vascular calcification by enhancing phosphaturia, preserving glomerular filtration, and directly inhibiting phosphate uptake by vascular smooth muscle.

S-Klotho can be administered in combination with TM5441 or other inhibitors of PAI-1 (plasminogen activator 1), since it is thought that PAI-1 inhibition or deficiency retards the development of senescence and protects organ structure and function while prolonging the lifespan of Klotho-deficient (kl/kl) mice.

S-Klotho can be administered in combination with sirtuin1 (SIRT1) or SIRT1-activating compounds (STACs) such as resveratrol. SIRT1, a type III protein deacetylase, is thought to be a novel anti-aging protein involved in regulation of cellular senescence/aging and inflammation. SIRT1 level and activity are decreased during lung inflammation caused by oxidative stress. The mechanism of SIRT1-mediated protection against inflammation is associated with the regulation of inflammation, premature senescence, telomere attrition, senescence associated secretory phenotype, and DNA damage response. A variety of dietary polyphenols and pharmacological activators are shown to regulate SIRT1 so as to intervene the progression of type 2 diabetes, cancer, cardiovascular diseases, and chronic obstructive pulmonary disease associated with inflammation. Thus some or all of the health benefits of SIRT-1 may be augmented by co-administration of SIRT1 and/or SIRTI-activating compounds given with S-Klotho.

S-Klotho can be administered in combination with one or more human Cells, Tissues, and Cellular and Tissue-Based Products (HCT/Ps), as recognized by the FDA. Such products can include, for example, one or more of bone (including demineralized bone, ligaments, tendons, fascia, cartilage, ocular tissues (corneas & sclera), skin, vascular grafts (veins & arteries), except preserved umbilical cord veins, pericardium, amniotic membrane (when used alone (-without added cells-) for ocular repair), dura mater, heart valve allografts, hematopoietic stem cells derived from peripheral or umbilical cord blood, semen, oocytes, or embryos. In at least one embodiment, the HCT/P can be or comprise one or more stem cells. Stem cell treatment for damaged bodily tissues and organs continues to grow in popularity. Administration of therapeutic, recombinant Klotho protein in combination with stem cells provided surprising, unexpected, and even synergistic outcomes for subjects in need thereof.

Embodiments of the present disclosure further include a combination product, comprising a therapeutic, recombinant Klotho protein in combination with human stem cells. The composition can also include a pharmaceutically-acceptable carrier as described herein. Such compositions can comprise or be classified as regenerative medicines, to treat, modify, reverse, or cure a serious or life-threatening disease or condition, as recognized by the FDA. Preliminary clinical evidence indicates that the composition (drug) has the potential to address unmet medical needs for such disease or condition.

Illustratively, stem cells can be or comprise mesenchymal stem cells (MSCs), such as from human umbilical cords or placentas. In at least one embodiment, the composition comprising huMSCs and a therapeutic, recombinant Klotho protein of the present disclosure attenuated the inflammatory and oxidative stress responses occurring in AKI, and/or reduced the expression of senescence-related proteins and microRNAs.

S-Klotho can be administered in combination with one or more senescence inhibitors. For instance, Klotho protein can be combined with Pin1-FOXM1 and/or other senescence inhibitors to enhance outcomes in patients receiving such treatment.

S-Klotho can be administered in combination with one or more of the following: Klotho stimulators (e.g., Vit. D, Losartan, Testosterone), GDF-11, Trichostatin A anti-fungal (e.g., GDF-11 Stimulator), TIMP-2, CCL-11 Inhibitor/antibodies, Dasatinib, Nicotinamide Riboside (e.g., NAD+), nicotinamide mononucleotide (NMN) (e.g., NDA+), AMPK Stimulators (e.g., Resveratrol, Aspirin, Salicylate, phytochemicals, DR), C60 Fullerene, Rapamycin, FGF inhibitor, Senolytics drugs/compounds such as FOXO4-p53 interfering peptides (e.g. FOXO4-DRI), inhibitors of the antiapoptotic proteins BCL-2 and BCL-xL.

Any of the foregoing or other treatments or co-administrations can have additive or synergistic effects over those of any of the treatments alone. For instance, co-administration of a Klotho protein with one or more of the foregoing can result in treatment outcomes greater than the sum of the individual outcomes of administering the components alone at similar concentrations. In addition, synergistic effects can include treatment outcomes similar to those of the individual outcomes of administering the components alone, but at lower concentrations. Synergistic effects can also include increasing the maximum effective dose of one or more of the components, reducing toxicity of one or more of the components, or any other beneficial result that is more than a mere additive effect of the individual treatment outcomes. In addition, additive effects of the individual treatment outcomes can comprise one or more synergistic effects. Such additive/synergistic effects may not be predicted or expected given the nature and understanding of the individual components.

As used herein, a combination treatment or co-administration can include treatment or administration of a combination product, composition, or formulation comprising a Klotho protein and one or more additional active ingredients. The one or more additional active ingredients can be selected from among the components, drugs, substances, treatment compositions, etc. described herein or others known in the art. For instance, the Klotho protein and one or more additional active ingredients can be co-formulated into an injectable (e.g., intramuscular, intravenous, etc.), ingestible, transdermal, inhalable, topical, or other formulation.

Alternatively, a combination treatment or co-administration can include treatment or administration of a Klotho protein and one or more additional active ingredients, but without the Klotho protein and one or more additional active ingredients being combined or formulated into a combination product, composition, or formulation. For instance, the Klotho protein and one or more additional active ingredients can each comprise or be in a separate injectable (e.g., intramuscular, intravenous, etc.), ingestible, transdermal, inhalable, topical, or other formulation.

It will also be appreciated that co-administration can comprise simultaneous administration of two or more components or distinct administrations of two or more components, the distinct administrations preferably being separated by a period of time. The period of time can be very small, in some embodiments. For instance, a second component of the Klotho protein and one or more additional active ingredients can be administered (e.g., injected) substantially, immediately following administration of a first component of the Klotho protein and one or more additional active ingredients. Alternatively, the first and second administrations can be separated by a time period of 1-60 seconds, 1-60 minutes, 1-24 hours, 1-7 days, 1-4 weeks, 1-12 months, and so forth, or any value or range of values therebetween. Similarly, simultaneous administration can include overlapping administration timeframes for the two or more components.

Klotho Protein Variants

Therapeutic S-Klotho proteins of various lengths (e.g., S-Klotho, isoform 1 or 2, 1-981, 29-981, 34-981, 36-981, 131-981, 1-549, 29-549, 34-549, 36-549, 131-549, and so forth) can be modified in a variety of ways to achieve various beneficial effects and/or results not exhibited in native Klotho proteins. Illustratively, the QuickChange XL Site-Directed Mutagenesis Kit (Stratagene) can be used to alter the nucleic acid sequence of various S-Klotho constructs. Other mutagenesis methods and kits as known in the art can also be used. For instance, various sub-cloning methods and kits are known in the art and commercially available.

In at least one embodiment of the present disclosure, a protein is modified with one or more C-terminal tags and/or N-terminal tags. Such tags can function to extend the serum and/or soluble half-life of the protein (in one or more therapeutic or other environments). Tags can also be useful as markers for the presence or diagnostic localization of the protein, isolation or removal of the protein, delivery or transport of the protein, binding of the protein to one or more targets (e.g., protein, nucleic acid, organelle, cellular structural component, etc.), enzymatic processing or cleavage, and so forth. In at least one embodiment, the C-terminus of the protein can be tagged with a TEV-Twin-Strep tag or sequence, an immunoglobulin (IgG1) Fc domain tag or sequence, or other tag or sequence as known in the art and/or described further herein. Additional description can be found in the articles "Fusion Proteins for Half-Life Extension of Biologics as a Strategy to Make Biobetters," "What is the future of PEGylated therapies?" and "Strategies for extended serum half-life of protein therapeutics," the entirety of each of which is incorporated herein by specific reference. In certain embodiments, a linker or linker peptide can be inserted and/or disposed between the (native or variant) Klotho protein sequence and the tag.

In some embodiments, the modified Klotho protein can include an alternative (e.g., native, non-native, and/or synthetic) signal peptide. For instance, in some embodiments, the native signal peptide sequences can be replaced and/or supplemented with an alternative signal peptide or signaling sequence (SS). In some embodiments, a native Methionine residue of a Klotho protein can be removed and a Methionine residue at the N-terminus of the SS can be included. Additional description can be found in the thesis "Generation of high expressing CHO cell lines for the production of recombinant antibodies using optimized signal peptides and a novel ER stress based selection system," the entirety of which is incorporated herein by specific reference. In certain embodiments, a linker or linker peptide can be inserted and/or disposed between the (native or variant) Klotho protein sequence and the alternative SS.

Some embodiments can include one or more amino acid variants. It will be appreciated that the present disclosure contemplates variation of any one or more of the native amino acids in any of the disclosed Klotho proteins to any other amino acid, whether naturally-occurring, synthetic, or otherwise configured.

S-Klotho C370S Protein Variant

In humans, the Klotho gene maps on chromosome 13q12. A variant, known as KL-VS, is present in approximately 15-25% of Caucasians. The variant is composed of six single nucleotide polymorphisms (SNPs), two of which cause amino acid substitutions (i.e. F352V and C370S—Phenylalanine 352 changed to Valine and Cysteine 370 changed to Serine). In vitro transfection assays have shown that secreted levels of klotho are reduced 6-fold for the V352 variant, while they are increased almost 3-fold for the S370 form. However, these two variants in the human KLOTHO gene segregate together and form the KL-VS haplotype that increases klotho secretion in the range of 1.6-fold. For instance, it has been reported that in a screening of over 300 individuals taken from the geographically and/or ethnically distinct cohorts, not a single individual was found to harbor only one of the V352 variant or the S370 variant.

An embodiment of the present disclosure includes a recombinant S-Klotho protein having the C370S homovariant (i.e., without the presence (or with deletion) of the F352V variant). The C370S variant can be produced and/or expressed in the context of any protein construct described herein. For instance, the C370S variant can be produced or expressed in the context of S-Klotho, isoform 1 or 2, 1-981, 29-981, 34-981, 36-981, 131-981, 1-549, 29-549, 34-549, 36-549, 131-549, and so forth, with or without a tag (e.g., (IgG) Fc tag, TEV-Twin-Strep tag, TEV sequence, etc.). Accordingly, the nucleic acid construct or cDNA from which the protein is expressed can be of corresponding length.

Embodiments can include producing a S370 heterozygous or homozygous variant construct, transferring (e.g., via transfection) the resulting construct, which encodes the S-Klotho C370S protein, into an appropriate expression system (e.g., CHO cells), and/or transiently expressing the S-Klotho S370 protein. The S370 Klotho protein may be expressed at higher levels than the F352V/C370S protein and/or wild-type F352/C370 protein. Embodiments can include purifying (and optionally quality-control testing) the expressed protein for therapeutic administration. Embodiments can include administering a therapeutic or therapeutically-effective amount of the S-Klotho C370S protein to a subject in need thereof. The subject may, for example, harbor or express the KL-VS variant. Alternatively, the subject may be of wild-type of other mutant or variant type. Administration of the recombinant S-Klotho C370S protein can lead to a beneficial increase in blood S-Klotho levels. Accordingly, the circulating concentration of S-Klotho in subjects that receive the therapeutic, recombinant, S-Klotho C370S protein may not be subjected to the dilutive effects that are observed when the F352V variant is present.

Therapeutic Treatment of Hyperphosphatemic Familial Tumoral Calcinosis (HFTC)

In affected human individuals, HFTC is caused by a histidine (H) to arginine (R) mutation at amino acid (AA) position 193 of S-Klotho—rs121908423. Without being bound to any theory, it is thought that the H193R mutation in HFTC individuals impairs the ability of S-Klotho to form a ternary complex with FGF23 and FGFR1c, which impairs KL-dependent FGF23 signaling. As a result, affected subjects present a severe metabolic disorder that manifests with hyperphosphatemia and massive calcium deposits in the skin and subcutaneous tissues. Some patients manifest recurrent, transient, painful swellings of the long bones associated with the radiographic findings of periosteal reaction and cortical hyperostosis and absence of skin involvement.

An embodiment of the present disclosure includes a S-Klotho protein having H193. The H193 protein can be produced or expressed in the context of any protein construct described herein. For instance, the H193 variant can be produced or expressed in the context of S-Klotho, isoform 1 or 2, 1-981, 29-981, 34-981, 36-981, 131-981, 1-549, 29-549, 34-549, 36-549, 131-549, and so forth, with or without a tag (e.g., Fc tag, TEV-Twin-Strep tag, TEV sequence, etc.). Accordingly, the nucleic acid construct or cDNA from which the protein is expressed can be of corresponding configuration.

Embodiments can include producing a H193 heterozygous or homozygous variant construct, transferring (e.g., via transfection) the resulting construct, which encodes the S-Klotho H193 protein, into an appropriate expression system (e.g., CHO cells), and/or transiently expressing the S-Klotho H193 protein. The H193 Klotho protein may also be expressed at higher levels than the R193 (or H193R) protein. Embodiments can include purifying (and optionally quality-control testing) the expressed protein for therapeutic administration. Embodiments can include administering a therapeutic or therapeutically-effective amount of the S-Klotho H193 protein to a subject in need thereof (e.g., a HFTC individuals, individual diagnosed with HFTC, or patient harboring the H193R (r5121908423) or other variant). Alternatively, the subject may be of wild-type of other mutant or variant type. Administration of the recombinant S-Klotho H193 protein can lead to a beneficial increase in blood S-Klotho levels. The administration may reverse or counteract the deleterious effects of the R193 mutation that is transcribed and circulated in HFTC individuals as a result of the H-to-R193 point mutation found in the human klotho gene in individuals affected with HFTC. Accordingly, the circulating concentration of S-Klotho H193 may help to counter the effects observed in H193R or HFTC individuals.

Therapeutic Treatment in CC Genotype Patients with End-Stage Renal Disease (ESRD)

Approximately 350,000 patients with end-stage renal disease (ESRD) suffer exceptionally high mortality rates in their first year of chronic hemodialysis. Both vitamin D and fibroblast growth factor (FGF)-23 levels correlate with survival in these patients. Without being bound to any theory, Klotho is a protein in the vitamin D/FGF-23 signaling pathway that has been linked with accelerated aging and early mortality in animal models. It has been hypothesized that genetic variation in the Klotho gene may be associated with survival in subjects with ESRD. Investigators tested the association between 12 single nucleotide polymorphisms (SNPs) in the Klotho gene and mortality in a cohort of ESRD patients during their first year on hemodialysis (n=1307 white and Asian). A significant association was discovered between the CC genotype of one tag SNP, rs577912 (a common HapMap variants with a minor allele frequency [MAF]>0.05 within the Klotho gene sequence located in intron 1), and increased risk for 1-yr mortality (RR, 1.76; 95% CI, 1.19-2.59; p=0.003). This effect in individuals with the CC genotype was even more marked among patients who were not treated with activated vitamin D supplementation (HR, 2.51; 95% CI, 1.18-5.34; p=0.005). In lymphoblastoid cell lines derived from HapMap subjects, the CC genotype was associated with a 16-21% lower Klotho expression compared with the AA or AC genotypes. However, none of the rs577912 SNPs nucleotide change described above result in an amino acid change in the Klotho protein. Accordingly, this functional SNP (r5577912) may quantitatively affect Klotho gene expression at the mRNA level.

An embodiment of the present disclosure includes a S-Klotho protein expressed from the AA or AC genotype. The protein can be produced or expressed in the context of any protein construct described herein. For instance, the protein can be produced or expressed in the context of S-Klotho, isoform 1 or 2. 1-981, 29-981, 34-981, 36-981, 131-981, 1-549, 29-549, 34-549, 36-549, 131-549, and so forth, with or without a tag (e.g., Fc tag, TEV-Twin-Strep tag, TEV sequence, etc.). Accordingly, the nucleic acid construct or cDNA from which the protein is expressed can be of corresponding length.

Embodiments can include producing a AA or AC heterozygous or homozygous construct, transferring (e.g., via transfection) the resulting construct, which encodes the S-Klotho protein, into an appropriate expression system (e.g., CHO cells), and/or transiently expressing the S-Klotho protein. Klotho protein expressed in AA or AC heterozygous or homozygous cells may be expressed at higher levels than in CC cells. Embodiments can include purifying (and optionally quality-control testing) the expressed protein for therapeutic administration. Embodiments can include administering a therapeutic or therapeutically-effective amount of the S-Klotho protein to a subject in need thereof (e.g., an individual or patient harboring the CC mutation at the one tag SNP, rs577912, having low endogenous S-Klotho protein expression, and/or with end-stage renal disease (ESRD)). Alternatively, the subject may be of wild-type of other mutant or variant type. Administration of the recombinant S-Klotho protein can lead to a beneficial increase in blood S-Klotho levels. The administration may reverse or counteract the deleterious effects of the CC mutation that is transcribed and circulated in individuals as a result of the point mutation(s) found in the human klotho gene in affected individuals. Accordingly, the circulating concentration of S-Klotho may help to counter the effects observed in CC individuals, especially those with end-stage renal disease (ESRD), namely mortality in the first year in ESRD patients undergoing chronic hemodialysis.

Therapeutic Treatment of Radiographic Hand Osteoarthritis (OA) and Osteophyte Osteoarthritis (OA) is a common complex disease with strong heritable components. Investigators studied the association between four putatively functional genetic variants in klotho gene and hand OA in a large female Caucasian population. The investigators found significant association between SNP G-395A and the presence/absence of radiographic hand OA and osteophyte formation. Allele G significantly increased the risk for radiographic hand OA and osteophytes with odds ratios (ORs) of 1.44 (P=0.008, 95% confidence interval (CI) 1.09-1.91) and 1.36 (P=0.006, 95% CI 1.09-1.70), respectively. From logistic regression modelling, genotype GG showed more than three-fold increased risk for both radiographic hand OA (OR=3.10, 95% CI 1.10-8.76) and osteophyte (OR=3.10, 95% CI 1.10-8.75) when compared to genotype AA. After adjustment for age, ORs for genotype GG further increased to 4.39 (P=0.006, 95% CI 1.51-12.74) for radiographic hand OA and to 4.47 (P=0.005, 95% CI 1.56-12.77) for osteophytes. The investigators also suggested that one variant (SNP G-395A) in the klotho gene is associated with the susceptibility of hand OA and appears to act through osteophyte formation rather than cartilage damage.

An embodiment of the present disclosure includes a S-Klotho protein expressed from a construct having SNP G395A. The resulting protein can be produced or expressed in the context of any protein construct described herein. For instance, the A395 variant can be produced or expressed in the context of S-Klotho, isoform 1 or 2, 1-981, 29-981, 34-981, 36-981, 131-981, 1-549, 29-549, 34-549, 36-549, 131-549, and so forth, with or without a tag (e.g., Fc tag, TEV-Twin-Strep tag, TEV sequence, etc.). Accordingly, the nucleic acid construct or cDNA from which the protein is expressed can be of corresponding length.

Embodiments can include producing a G395A heterozygous or homozygous construct, transferring (e.g., via transfection) the resulting construct, which encodes the S-Klotho protein, into an appropriate expression system (e.g., CHO cells), and/or transiently expressing the S-Klotho protein. Klotho protein expressed in A395 heterozygous or homozygous cells may be expressed at higher levels than in G396 cells. Embodiments can include purifying (and optionally quality-control testing) the expressed protein for therapeutic administration. Embodiments can include administering a therapeutic or therapeutically-effective amount of the S-Klotho protein to a subject in need thereof (e.g., an individual or patient harboring the G395 SNP and/or (at risk of developing) radiographic hand osteoarthritis (OA) and/or osteophytes. Alternatively, the subject may be of wild-type of other mutant or variant type. Administration of the recombinant S-Klotho protein can lead to a beneficial increase in blood S-Klotho levels. The administration may reverse or counteract the deleterious effects of the G395 SNP that is transcribed and circulated in affected individuals. Accordingly, the circulating concentration of S-Klotho may help to counter the effects observed in G395 individuals, especially those at risk of developing radiographic hand osteoarthritis (OA) and/or osteophytes. Administration of the G-395A S-Klotho protein may, therefore, decrease the risk of radiographic hand osteoarthritis (OA) and osteophyte formation in patients (e.g., patients harboring the G395 SNP.

Therapeutic Treatment of Metabolic Syndrome

The risk and/or incidence of metabolic syndrome (MetS), a cluster of cardiometabolic risk factors including abdominal obesity, hyperglycemia, dyslipidemia and hypertension, increases with age. In elderly adults, MetS not only increases the risk of cardiovascular diseases and type 2 diabetes, but also is associated with cognitive decline and disability. Current evidence suggests that MetS is partly heritable, and genetic factors plays a greater role than environment factors on the incidence of MetS. Investigator discovered an association between the G-395A polymorphism and metabolic syndrome (MetS) among a population of Chinese nonagenarians and centenarians. Subjects were from the Project of Longevity and Aging in Dujiangyan (PLAD). The genotyping of G-395A (r51207568) in the promoter region of the Klotho gene was performed using the TaqMan allelic discrimination assay. MetS was diagnosed according to the International Diabetes Federation criteria. Included were 695 subjects aged 93.5±3.2 years. G and A allele frequencies were 0.852 and respectively. In the whole population, the frequency of MetS was 10.8% and 5.9% in the GG and GA+AA genotype group, respectively (p=0.004). The −395A allele carriers had significantly lower risk of MetS in the whole population (odd ratio [OR] 0.50, 95% confidential interval [CI] 0.25 to 0.98) and in women (OR 0.51, 95% CI 0.24 to 0.97), but not in men (OR 0.42, 95% CI 0.05 to 3.85). In the whole population and women, the relationship between the Klotho G-395A SNP and MetS might be due to its influence on high blood pressure (OR 0.48, 95% CI 0.34 to 0.67; OR 0.47, 95% CI 0.31 to 0.71, respectively) and hypertriglyceridemia (OR 0.66, 95% CI 0.39 to 0.95; OR 0.54, 95% CI 0.31 to 0.98, respectively). In men, this relationship might be due to its influence on high blood pressure (OR 0.47, 95% CI 0.25 to 0.90) and low HDL-C(OR 0.69, 95% CI 0.27 to 0.93). Investigators concluded that the −395A allele carriers of the Klotho gene were correlated with lower risk of MetS among Chinese nonagenarians and centenarians, especially in women.

An embodiment of the present disclosure includes a S-Klotho protein expressed from a construct having the −395A allele. The resulting protein can be produced or expressed in the context of any protein construct described herein. For instance, the A395 allele can be produced or expressed in the context of S-Klotho, isoform 1 or 2, 1-981, 29-981, 34-981, 36-981, 131-981, 1-549, 29-549, 34-549, 36-549, 131-549, and so forth, with or without a tag (e.g., Fc tag, TEV-Twin-Strep tag, TEV sequence, etc.). Accordingly, the nucleic acid construct or cDNA from which the protein is expressed can be of corresponding length.

Embodiments can include producing a −395A heterozygous or homozygous construct, transferring (e.g., via transfection) the resulting construct, which encodes the S-Klotho protein, into an appropriate expression system (e.g., CHO cells), and/or transiently expressing the S-Klotho protein. Klotho protein expressed in A395 heterozygous or homozygous cells may be expressed at higher levels than in G396 cells. Embodiments can include purifying (and optionally quality-control testing) the expressed protein for therapeutic administration. Embodiments can include administering a therapeutic or therapeutically-effective amount of the S-Klotho protein to a subject in need thereof (e.g., an individual or patient harboring the G395 SNP and/or (at risk of developing) metabolic syndrome (MetS). Alternatively, the subject may be of wild-type of other mutant or variant type. Administration of the recombinant S-Klotho protein can lead to a beneficial increase in blood S-Klotho levels. The administration may reverse or counteract the deleterious effects of the G395 SNP that is transcribed and circulated in affected individuals. Accordingly, the circulating concentration of S-Klotho may help to counter the effects observed in G395 individuals, especially those at risk of developing metabolic syndrome (MetS). Administration of the G-395A S-Klotho protein may, therefore, decrease the risk of metabolic syndrome (MetS) in patients (e.g., patients harboring the G395 SNP, in elderly human, and/or in women).

Therapeutic Treatment of Cancer

S-Klotho is thought to inhibit basal Wnt signaling activity, thereby functioning as a tumor suppressor for colorectal cancer (CRC). In addition, klotho gene variants associated with lifespan differences may repress butyrate-mediated Wnt hyperactivation, and thus increase the risk of CRC. It has been hypothesized that in this manner, the type of klotho variant present, and its relative expression, can interact with levels of butyrate derived from diet to modify CRC risk. Moreover, mTOR signaling has also been linked to human aging, and crosstalk between Wnt and mTOR signaling may influence colonic tumorigenesis The KL-VS variant or other construct can serve as a vehicle for investigating which SNPs (e.g., within KL-VS) are responsible for influencing S-Klotho to produce a decrease in basal Wnt signaling and/or the suppression of butyrate-mediated Wnt hyperactivation—the latter Wnt-related activities which have been associated with S-Klotho tumor suppression. Embodiments include modifying the appropriate amino acids (e.g., in the KL-VS stretch of S-Klotho) shown to influence the tumor suppressing action of the KL-VS variant. An embodiment of the present disclosure includes a recombinant S-Klotho protein having one or more amino acid alterations in the KL-VS stretch of 6 SNPs. The proteins can be produced and/or expressed in the context of any protein construct described herein. For instance, the proteins can be produced or expressed in the context of S-Klotho, isoform 1 or 2, 1-981, 29-981, 34-981, 36-981, 131-981, 1-549, 29-549, 34-549, 36-549, 131-549, and so forth, with or without a tag (e.g., Fc tag, TEV-Twin-Strep tag, TEV sequence, etc.). Accordingly, the nucleic acid construct or cDNA from which the protein is expressed can be of corresponding length.

Embodiments can include producing a heterozygous or homozygous variant construct, transferring (e.g., via transfection) the resulting construct, which encodes the S-Klotho protein, into an appropriate expression system (e.g., CHO cells), and/or transiently expressing the S-Klotho protein. The Klotho protein may be expressed at higher levels than the other Klotho proteins, including wild-type. Embodiments can include purifying (and optionally quality-control testing) the expressed protein for therapeutic administration. Embodiments can include administering a therapeutic or therapeutically-effective amount of the S-Klotho protein to a subject in need thereof (e.g., a patient with or at risk of developing colorectal cancer (CRC) or another tumor). The subject may, for example, harbor or express a Klotho variant with decreased Wnt inhibition activity. Alternatively, the subject may be of wild-type of other mutant or variant type. Administration of the recombinant S-Klotho protein can lead to a beneficial increase in blood S-Klotho levels.

Therapeutic Treatment of Age-Related Conditions

Investigators have discovered an association between Klotho and biological parameters commonly accepted as indicators of the clinical status in hospitalized older patients. The investigators genotyped the single-nucleotide polymorphisms (SNPs) rs9536314, rs1207568, and rs564481 at the KL locus in 594 hospitalized older patients (65-99 years), consecutively attending a geriatric ward, and tested the association of these KL variants with biological quantitative traits using analyses of covariance and genetic risk score models. Significant associations of rs9536314 with serum levels of hemoglobin, albumin, and high-density lipoprotein cholesterol (HDL-C) as well as significant associations of rs564481 with serum levels of hemoglobin, fasting insulin, and fasting glucose were observed. Gender-segregated analyses confirmed these associations, and suggests that the associations of KL genotypes with HDL-C, fasting glucose and fasting insulin levels may be driven by the female gender, while the association with serum levels of hemoglobin may be driven by the male gender. The association of KL genotypes with creatine levels was found in females, while the association with insulin-like growth factor-1 (IGF-1) and lymphocytes count (LC) was found in males. The genetic risk score (GRS) models further confirmed significant associations among KL SNPs and hemoglobin, total cholesterol, and HDL-C. Gender-segregated analyses with the GRS-tagged approach confirmed the associations with HDL-C, fasting glucose, and fasting insulin levels in females, and with hemoglobin and LC in males. The findings suggested that KL locus may influence quantitative traits such as serum levels of lipid, fasting glucose, albumin and hemoglobin in hospitalized older patients, with some gender differences suggested for creatine, IGF-1 levels, and LC, thus being one of the genetic factors possibly contributing to age-related diseases and longevity.

An embodiment of the present disclosure includes a S-Klotho protein as described herein. Embodiments can include producing a suitable klotho construct, transferring (e.g., via transfection) the construct, which encodes the S-Klotho protein, into an appropriate expression system (e.g., CHO cells), and/or transiently expressing the S-Klotho protein. Embodiments can include purifying (and optionally quality-control testing) the expressed protein for therapeutic administration. Embodiments can include administering a therapeutic or therapeutically-effective amount of the S-Klotho protein to a subject in need thereof (e.g., an individual or patient, optionally elderly and/or suffering from an aging-related condition, low endogenous S-Klotho protein expression, and/or symptoms of age-related condition or decreased longevity). Administration of the recombinant S-Klotho protein can lead to a beneficial increase in blood S-Klotho levels. The administration may reverse or counteract the deleterious effects of the aging-related condition and/or influence, in a positive therapeutic manner, quantitative traits such as serum levels of total cholesterol, HDL-C, fasting glucose, fasting insulin, albumin, creatine, IGF-1, hemoglobin, and lymphocytes count (e.g., in hospitalized and/or elderly patients).

It should be appreciated that in one or more methods of treatment described herein, an individual who is to be treated can have a mutation in the Klotho gene (e.g., genomically encoded heterozygous mutation(s) or homozygous mutation), and the treatment regimen can include administering a therapeutic dose of a peptide comprising wild-type Klotho and/or any one or more variants of Klotho disclosed herein, including, for example, a variant similar to the mutation expressed by the individual. Alternatively, an individual to be treated can encode/express wild-type Klotho, and the treatment regimen can include administering a therapeutic dose of a peptide comprising wild-type Klotho and/or any one or more variants of Klotho disclosed herein. In some embodiments, and regardless of the native wild-type or mutant form of Klotho expressed by the individual, a treatment method can include determining a low-level (e.g., compared to a control group) of circulating and/or cell-bound Klotho protein and administering a therapeutic dose that operatively restores concentrations of circulating and/or cell-bound Klotho to at least a homeostatic level. In some embodiments, this may include determining a level of Klotho (e.g., a gene expression level, a protein expression level, circulating levels, etc.) before administering the therapeutic concentration. Additionally, the therapeutic dose can be dependent upon the level of Klotho determined in the individual. In some embodiments, the therapeutic dose exceeds the homeostatic level, such as, for example, by a scalar multiple of the homeostatic level (e.g., 1.5 times more, 2 times more, 3 times more, 4 times more, 5 times more, 6 times more, 7 times more, 8 times more, 9 times more, 10 times more, 15 times more, 20 times more 25 times more, 30 times more, 40 times more, 50 times more, 75 times more, 100 times more, 500 times more 1,000 times more, 10,000 times more, etc.).

More particularly, it should be appreciated that therapeutic treatments for age-related conditions can include administering a therapeutic concentration of one or more Klotho variants. In some implementations, this can include treating a patient with a therapeutic concentration of a Klotho variant (or combination of Klotho variants) disclosed herein, such as, for example, peptides selected from any one or more of SEQ ID NO: 2 through SEQ ID NO: 70 or SEQ ID NO: 107 through SEQ ID NO: 120. It should be appreciated that the age-related condition can be treated with a Klotho variant that is the same or different than that expressed and/or encoded by the individual having an age-related condition. For example, an individual suffering from an age-related condition may genetically encode one or more wild-type or variants of Klotho, and the individual may express the wild-type and/or variant Klotho proteins at homeostatic levels (as compared to a control group), less than homeostatic levels, or not at all. A therapeutic regimen aimed at treating the individual's age-related condition can include administering one or more Klotho variants disclosed herein.

Prophylactic S-Klotho Administration

In addition to the foregoing, embodiments of the present disclosure can include administering a therapeutic or therapeutically-effective amount of an S-Klotho protein to an individual or subject in need thereof for prophylactic purposes and/or maintenance of certain health attributes. For example, administration of certain S-Klotho proteins can help maintain youthfulness in optionally aging patients not yet suffering from a diagnosed aging-related condition. Accordingly, while certain embodiments of the present disclosure can relate to and/or comprise treating a condition in a patient, other embodiments can relate to and/or comprise preventing, inhibiting development of, and/or prophylactically addressing one or more conditions. For example, S-Klotho can be administered to persons with a genetic disorder with mutations in one or more Klotho genes.

EXAMPLES

Example 1

Table 2 illustrates the results from transient expression and purification of the recited Klotho variants in HEK and/or CHO cell lines. In the results provided in Table 2, below, the following abbreviated protocols were followed.

For Fc fusion proteins, protein expression vectors transfected into HEK293.sus or CHO using standard ATUM methods. Briefly, cells were grown for 7 days and harvested. Cell counts are given in notes section. Supernatant pH was adjusted with 1M Hepes pH 7.4 and sodium azide added. KanCap A resin was used to capture proteins. Resin was washed with PBS. Resin was washed with PBS plus 1M NaCl. Resin was washed with PBS. Proteins were eluted with 50 mM Citrate pH 3.5, 100 mM NaCl. Proteins were immediately neutralized with 1M Tris pH 8, 0.5M Arginine. SDS PAGE gel samples were removed at this stage. Proteins were buffer exchanged into PBS. Protein was quantified by OD280, quantity and concentration was determined using calculated extinction coefficient. Reduced and non-reduced SDS-PAGE (Biorad criterion Tris/Glycine/SDS, 4-20%) were used to determine purity and approximate molecular mass. Aggregation status was determined by HPLC, with detection at 280 nm using a Sepax Zenix-C SEC-300, 3 um, 300 Å, 4.6*150 mm size exclusion column and PBS running buffer. Proteins were shipped as aliquots after filter sterilization, snap frozen in liquid nitrogen. It should be noted that for the Fc tagged proteins, as in a prior round of purification, losses of protein were observed during desalting into PBS, as determined from samples run on SDS-PAGE before and after purification. These proteins are expressed but from the HPLC, problems arose during desalting or assay on the silica HPLC column in PBS. Accordingly, buffer selection can be optimized.

For Strep tagged proteins, protein expression vectors transfected into HEK293.sus or CHO using standard ATUM methods. Briefly, cells were grown for 7 days and harvested. Supernatant pH was adjusted with 1M Hepes pH 7.4 and sodium azide added. BioLock biotin sequestration reagent was added. StrepTactin superflow resin was used to capture proteins. Resin was washed with 100 mM Tris pH 8, 150 mM NaCl, 1 mM EDTA. Proteins were eluted with 100 mM Tris pH 8, 150 mM NaCl, 1 mM EDTA plus 2.5 mM Desthiobitin. Protein was quantified by OD280, quantity and concentration was determined using calculated extinction coefficient. Reduced and non-reduced SDS-PAGE (Biorad criterion Tris/Glycine/SDS, 4-20%) were used to determine purity and approximate molecular mass. Aggregation status was determined by HPLC, with detection at 280 nm using a Sepax Zenix-C SEC-300, 3 um, 300A, 4.6*150 mm size exclusion column and PBS running buffer. Proteins were shipped as aliquots after filter sterilization, snap frozen in liquid nitrogen. It should be noted that for the Strep tagged proteins, samples were assayed in elution buffer. This elution buffer is very 'neutral' and is not detrimental to proteins. Also, the running buffer for the SEC column was PBS, so the proteins underwent a buffer exchange during assay. Absorbance at times above 7 minutes are small molecule.

TABLE 2

| Protein Name | OD280 nm | Conc. (mg/mL) | Extinction Coefficient | Molecular Weight (Da) | Titer (mg/L) |
|---|---|---|---|---|---|
| Native Klotho ECD (34-981)-nativeSS-strep-HEK | 2.01 | 0.95 | 246780 | 116615 | 6.18 |
| Native Klotho ECD (34-981)-ATUMSS-strep-HEK | 1.73 | 0.79 | 246780 | 113119 | 5.16 |
| Klotho ECD variant-1(36-981)-ATUMSS-strep-HEK | 0.89 | 0.41 | 246780 | 112893 | 2.64 |
| Native secreted/Isoform 2 (34-549)-nativestrep-HEK | 1.33 | 0.63 | 140510 | 66255 | 4.07 |
| Native secreted/Isoform 2 (34-549)-ATUMSS-strep-HEK | 2.84 | 1.27 | 140510 | 62760 | 8.24 |
| Secreted variant (36-549)-ATUMSS-strep-HEK | 1.40 | 0.62 | 140510 | 62534 | 4.04 |
| Klotho ECD variant-2 (131-981)-ATUMSS-strep-HEK | 1.12 | 0.52 | 221800 | 103079 | 3.40 |
| Native Klotho ECD (34-981)-nativeSS-Fc-HEK | 0.02 | 0.01 | 270075 | 138668 | 0.27 |
| Native Klotho ECD (34-981)-ATUMSS-Fc-HEK | 0.01 | 0.00 | 270075 | 135172 | 0.12 |
| Klotho ECD variant-1(36-981)-ATUMSS-Fc-HEK | −0.04 | −0.02 | 270075 | 134946 | −0.48 |
| Native secreted/Isoform 2 (34-549)-nativeSS-Fc-HEK | 0.03 | 0.02 | 163805 | 88308 | 0.43 |
| Native secreted/Isoform 2 (34-549)-ATUMSS-Fc-HEK | 0.05 | 0.03 | 163805 | 84813 | 0.76 |
| Secreted variant (36-549)-ATUMSS-Fc-HEK | −0.01 | −0.00 | 163805 | 84587 | −0.08 |
| Klotho ECD variant-2 (131-981)-ATUMSS-Fc-HEK | −0.01 | −0.01 | 245095 | 125132 | −0.15 |
| Native Klotho ECD (34-981)-nativeSS-strep-CHO | 0.42 | 0.20 | 246780 | 116615 | 1.97 |
| Native Klotho ECD (34-981)-ATUMSS-strep-CHO | 0.28 | 0.13 | 246780 | 113119 | 1.30 |
| Klotho ECD variant-1(36-981)-ATUMSS-strep-CHO | 0.15 | 0.07 | 246780 | 112893 | 0.68 |
| Native secreted/Isoform 2 (34-549)-nativeSS-strep-CHO | 0.26 | 0.12 | 140510 | 66255 | 1.24 |
| Native secreted/Isoform 2 (34-549)-ATUMSS-strep-CHO | 0.36 | 0.16 | 140510 | 62760 | 1.61 |
| Secreted variant (36-549)-ATUMSS-strep-CHO | 0.22 | 0.10 | 140510 | 62534 | 0.98 |
| Klotho ECD variant-2 (131-981)-ATUMSS-strep-CHO | 0.19 | 0.09 | 221800 | 103079 | 0.86 |
| Native secreted/Isoform 2 (34-549)-nativeSS-Fc-CHO | 0.12 | 0.06 | 163805 | 88308 | 1.54 |
| Native secreted/Isoform 2 (34-549)-ATUMSS-Fc-CHO | 0.16 | 0.08 | 163805 | 84813 | 2.05 |

It should be appreciated that the expression and/or purification of the Klotho variants disclosed in Table 2 and/or shown in FIGS. 4A through 5B, in addition to one or more other Klotho variants disclosed herein but not shown in Table 2, can, in some embodiments, result in advantages over the expression and/or purification of native Klotho. For example, there can be a reduction in the number and/or types of alternative products when expressing and/or purifying Klotho variants. Additionally, or alternatively, there can be an increase in expression level of the desired Klotho variant compared to the expression level of native Klotho. Additionally, or alternatively, the desired Klotho variant is expressed and/or purified in a purer form under comparable conditions and methods (e.g., the concentration of the desired Klotho variant is increased with a concomitant decrease in side products expressed and/or purified).

Example 2

Stable expression of the (human) Klotho derived proteins represented in SEQ ID NO: 52 (N'-human alpha Klotho 34-981 isoform 1_(G45)$_2$ linker_human IgG1 Fc-C'), SEQ ID NO: 54 (N'-human alpha Klotho 34-549 isoform 2_(G45)$_2$ linker_human IgG1 Fc-C'), and SEQ ID NO: 66 (N'-human alpha Klotho 34-981 isoform 1 Twin-Strep cleavage site residues) was performed in CHO cells. Each of the three Klotho protein constructs was expressed with an N-terminal ATUM signal sequence, which was then cleaved during the stable expression/purification process to yield the N-terminal (Klotho protein) amino acid. C-terminal to the Klotho protein sequence in SEQ ID NOS: 52 and 54 is a GS linker and an Fc-fusion tag (human IgG1 Fc domain), which are (or appear to be) retained in the expressed protein. C-terminal to the Klotho protein sequence in SEQ ID NOS: 52 is a TEV-Twin-Strep tag (with GS linker), which is cleaved following the glutamine 8 (Q8) of the TEV-Twin-Strep tag, to release the Twin-Strep tag portion and retain at least a portion of the TEV (protease recognition or consensus) sequence.

The coding sequences were codon optimized using DNA2.0 (ATUM) proprietary algorithms. The genes were synthesized and Pd3600 transposon backbone based expression constructs were assembled. An example of the assembled expression construct 291645, designed to express the protein of SEQ ID NO: 52 is presented below:

```
LOCUS    11198 bp    DNA    SYN
SOURCE    Synthetic
ORGANISM    Synthetic
COMMENT SS_human alpha Klotho isoform 1 34-981_G4Sx3_IgG1 Fc domain
FEATURES       Location/Qualifiers
   source   1..11198
      /organism="Synthetic"
   misc feature 1..1213
      /product="Insulator"
      /label="Insulator"
   misc_feature 1214..1235
      /product="Element 12"
      /label="Element 12"
   misc_feature   complement(1236..1458)
      /product="pA_SV40 (bidirectional)"
      /label="pA_SV40 (bidirectional)"
   misc_feature 1459..1467
      /product="Element 13"
      /label="Element 13"
   CDS      complement(1468..2589)
      /gene="Glutamine synthetase"
      /codon_start=1
   misc_feature   complement(2590..2810)
      /product="GS promoter"
      /label="GS promoter"
   misc_feature   2811..2829
      /product="Element 15"
      /label-"Element 15"
   misc_feature   2830..4240
      /product="EF1 promoter (human)"
      /label="EF1 promoter (human)"
   misc_feature   4241..4321
      /product="UTR"
      /label="UTR"
   CDS      4322..4378
      /gene="SS_IgVH-Mm"
      /codon start=1
   CDS      4379..7222
      /gene="Klotho"
      /codon start=1
   CDS      7223..7252
      /gene="linker_(G4S)x2"
      /codon start=1
      /translation="GGGGSGGGGS"
   CDS      7253..7936
      /gene="IgG1-noCH1-Hs"
      /codon_start=1
   misc_feature   7937..7951
      /product="Element 2"
      /label="Element 2"
   misc_feature   7952..8761
      /product-"EES"
      /label="EES"
```

```
misc_feature    8762..9487
    /product="HPRE+"
    /label="HPRE+"
misc feature    9488..9874
    /product="pA_Globin-Oc"
    /label="pA_Globin-Oc"
misc_feature    9875..9902
    /product="Element 3"
    /label="Element 3"
misc_feature    9903..11198
    /product="Insulator"
    /label="Insulator"
Codon Optimized sequence (bold): increases expression of the Klotho protein
Signal Peptide: 4322-4378
Klotho - mature form: 4379-7222
Linker: 7223-7252
IgG1-Fc: 7253-7936
```

A GS knockout CHOK1 derivative host cell line was used to express the human Klotho variants. The cells have been co-transfected, with Leap-In transposon based expression plasmids (ATUM) coding for the three different hKlotho designs and Leap-In tranposases (ATUM). The transfections were performed by electroporation using a Neon apparatus (Thermo). Transfected cells were selected under glutamine free conditions and the resulting stable pools were cryopreserved. Cells form the established stable pools were inoculated into shake flasks and fed batch production studies were conducted using ATUM's small scale established feeding and cell culture conditions. Clarified harvest samples were collected and submitted for Western blot analysis using anti-Fc antibody- (SEQ ID NOS: 52 and 54) or Strep-Tactin- (SEQ ID NO: 66) HRP conjugate based detection. Example Western blots are shown in FIGS. 4A-5B.

Stable pool 291645 expressing the FL-ECD (34-981)-Fc Klotho derivative (SEQ ID NO: 52) produces the protein predominantly at the expected size (see FIG. 4A). The predicted size of the full length extracellular domain-Fc fusion protein monomer is 139 kDa. The predominant anti-Fc positive band is at the predicted ~140 kDa size (arrow) indicating that expression construct 291645 expresses the correct size fusion protein. As expected, the protein dimerizes under native and non-reducing conditions (see FIG. 4B). Under non-reducing conditions the full length extracellular domain-Fc fusion protein should form homodimers. The size of the predominant band detected by anti Fc antibody on a non-reducing Western blot (arrow) consistent with the formation of the predicted homodimers.

The FL-ECD (34-981)-TEV-Twin-Strep molecule expressed by stable pool 291647 (SEQ ID NO: 66), also shows the correct size on Western blots and remains a monomer under native and non-reducing conditions (see FIGS. 5A-5B). The expected size isoform-2—Fc variant represents the secreted human Klotho protein. The predicted molecular mass of the mature full length ECD (34-981)-twin-strep tagged Klotho protein (SEQ ID NO: 66), is 109 kDa. Non-reduced Western blot analysis demonstrates the successful expression of the correct size protein from CHO cells coded by expression construct 291647 (see FIG. 5A). Non-reduced denatured Western blot analysis indicates that the full length extracellular domain of hKlotho does not form covalent homodimers when secreted from CHO cells (see FIG. 5B). Other protein constructs represented in the accompanying Sequence Listing were also prepared.

Preliminary results indicated that designed recombinant fusion proteins are being expressed and purified in suitable titer ranges and are soluble in acceptable buffers, carriers, and excipients.

Example 3

A study to determine the Acute Tolerated Dose (ATD) of Alpha Human Native Klotho and Alpha Human Fc-Fusion Klotho proteins following intravenous administration in male Sprague-Dawley rats was conducted. In the acute tolerated dose study, the safety of the test articles Alpha Human Native Klotho and Alpha Human Fc-Fusion Klotho proteins was assessed in male Sprague-Dawley rats. Prior to dose administration, 21 animals were subcutaneously implanted with transponders. On Study Day −1, animals were randomized into seven groups of three, based on body weights. Alpha Human Native Klotho protein was tested at three dose concentrations of 10 µg/kg, 30 µg/kg, and 100 µg/kg (based on individual body weight) administered intravenously at a dose volume of 1 ml/kg (based on individual body weight) in vehicle (PBS, pH 7.2) on Study Day 0.

Alpha Human Fc-Fusion Klotho protein was also tested at three dose concentrations of 3 µg/kg, 10 µg/kg and 30 µg/kg (based on individual body weight) administered intravenously at a dose volume of 1 ml/kg (based on individual body weight) in vehicle (PBS, pH 7.2) on Study Day 0. Dosing began with a vehicle-only (PBS, pH 7.2) Group, 10 µg/kg Alpha Human Native Klotho protein Group, and 3 µg/kg Alpha Human Fc-Fusion Klotho protein Group on Study Day 0 and were staggered by at least 24 hours between each test article dose level group. All dosing was given once on the respective start date. Animals were observed for any adverse effects for maximum of 14 days following treatment.

In-life measurements included twice-daily checks for morbidity and mortality, and clinical observations were noted daily. Body weight measurements were recorded daily. Following completion of the observation phase, all animals were euthanised via cardiac exsanguination. Terminal measurements included blood hematology, serum biochemistry and coagulation. Gross pathology changes were recorded for all animals at necropsy and weights of ten organs (adrenals, brain, epididymides, heart, kidneys, liver, spleen, testes, thyroid/parathyrod and thymus) were taken.

Table 3 presents a summary of study animals.

TABLE 3

| Species/Strain/Sex | Age Range | Total Number of Animals | Number of Animals per Group | Number of Groups |
|---|---|---|---|---|
| Rat/Sprague Dawley/M | 8 weeks | 21 | 3 | 7 |

Table 4 presents a summary of study design.

TABLE 4

| Group | Test Article | Dose Level μg/kg |
|---|---|---|
| 1 | PBS, pH 7.2 | — |
| 2 | Alpha Human Native Klotho | 10 |
| 3 | Alpha Human Native Klotho | 30 |
| 4 | Alpha Human Native Klotho | 100 |
| 5 | Alpha Human Fc-Fusion Klotho | 3 |
| 6 | Alpha Human Fc-Fusion Klotho | 10 |
| 7 | Alpha Human Fc-Fusion Klotho | 30 |

For Group Assignment: Matched Pair Distribution, an optimized distribution method using an algorithm that matches the individual measurement values with the mean of all selected animals was performed. The method begins by taking matching pairs that average close to the mean of all selected animals and then distributes them into groups that will then match the average (or as close as possible) of the mean of all selected animals. Animals are distributed so that the average of the measurement for each group will be as close to the mean of all selected animals as possible.

For Statistical Analyses, descriptive statistics were generated from Study data. Data was assessed to determine whether parametric or non-parametric analysis was appropriate. For parametric data, analysis of variance (ANOVA) followed by post-hoc tests was performed to determine significant differences between treatments, time points, and/or groups. For non-parametric data, appropriate statistical analyses was performed (e.g., Kaplan-Meier Survival, Kruskal-Wallis One-way ANOVA, Mann-Whitney or Wilcoxon Rank Sum, etc.).

TABLE 5

| Task | Method & Collection | Sample Info/Special Instructions |
|---|---|---|
| Blood for clinical biochemistry | collected into non-heparinized tubes for serum preparation | stored at −80° C. and shipped on dry ice |
| Blood for coagulation analyses | collected into sodium citrate tubes | stored at −80° C. and shipped on dry ice |
| Whole blood for CBC count hematology analysis | collected into K₂EDTA tubes | stored at 2-8° C. and shipped |

Table 6 summarizes sample collection tasks.

TABLE 6

| Task | Frequency |
|---|---|
| Body weight | Daily |
| Adrenals, brain, epididymides, heart, kidneys, liver, spleen, testes, thyroid/parathyroid and thymus to be excised and weighted | At termination |

TABLE 6-continued

| Task | Frequency |
|---|---|
| Clinical Observation | Daily |
| Morbidity Check | 2x daily |
| Mortality Observation | 2x daily |

Any animal whose body weight dropped below 85% of initial body weight, or displays severe, prolonged adverse clinical signs was to be euthanized. Animals were to be euthanized via cardiac bleed for collection of plasma, serum and whole blood as indicated above.

Preliminary results indicated that the rats tolerate relatively high doses of recombinant Klotho proteins administered thereto.

Example 4

A study to determine Pharmacokinetics of Alpha Human Native Klotho and Alpha Human Fc-Fusion Klotho Proteins Following IV Dosing in Male Sprague Dawley Rats was conducted. Prior to Study Day 0, animals were subcutaneously implanted with transponders. On Study Day −1 body weights were acquired and animals were randomized based on body weight. On Study Day 0, animals in Groups 5, 6, and 7 (10 animals per group) received a single dose of Alpha Human Fc-Fusion Klotho protein intravenously via the tail vein (see detailed dosing schedule, below) at 3, 10, and 30 μg/kg in 1 ml/kg vehicle (PBS, pH 7.2), respectively. On Study Day 1, animals in Groups 2, 3 and 4 (10 animals per group) received a single dose of Alpha Human Native Klotho protein intravenously via the tail vein (see detailed dosing schedule, below) at 10, 30 and 100 μg/kg protein in 1 ml/kg vehicle (PBS, pH 7.2), respectively. Animals in the vehicle Group 1 (3 animals) was also dosed on Study Day 1 at 1 ml/kg vehicle (PBS, pH 7.2) without protein. The volume of dosing solution administered to each animal was calculated and adjusted based on individual body weight measured acquired on Study Day −1.

Three blood samples were obtained from each group (2-7) for all time points, equating to three blood samples per rat (see detailed blood collection schedule, below). Time-point blood samples were obtained pre-dose, 3 min, 10 min, 20 min, 30 min, 1 hr, 2 hr, 4 hr, 8 hr and 24 hr post-dose (Groups 2, 3 and 4), as presented in Table 7, below.

TABLE 7

| | Group 2, 3 and 4 | | | | | | | | | |
|---|---|---|---|---|---|---|---|---|---|---|
| Rat ID | 0 min | 3 min | 10 min | 20 min | 30 min | 1 hr | 2 hr | 4 hr | 8 hr | 24 hr |
| 1 | X | | | | X | | | X | | |
| 2 | | X | | | | X | | | X | |
| 3 | | | X | | | | X | | | X |
| 4 | X | | | X | | | | X | | |
| 5 | | X | | | X | | | | X | |
| 6 | | | X | | | X | | | | X |
| 7 | X | | | X | | | X | | | |

TABLE 7-continued

| | Group 2, 3 and 4 | | | | | | | | |
|---|---|---|---|---|---|---|---|---|---|
| Rat ID | 0 min | 3 min | 10 min | 20 min | 30 min | 1 hr | 2 hr | 4 hr | 8 hr | 24 hr |
| 8 | X | | | | X | | | X | | |
| 9 | | X | | | | X | | | X | |
| 10 | | | X | | | | X | | | X |

Time-point blood samples were obtained pre-dose, 3 min, 1 hr, 4 hr, 8 hr, 24 hr, 48 hr, 72 hr, 96 hr and 7 days post-dose (Groups 5, 6, and 7), as presented in Table 8, below. An additional blood collection at 14 days post dosing was obtained in Groups 5, 6, and 7.

TABLE 8

| | Groups 5, 6 and 7 | | | | | | | | | |
|---|---|---|---|---|---|---|---|---|---|---|
| Rat ID | 0 min | 3 min | 1 hr | 4 hr | 8 hr | 24 hr | 48 hr | 72 hr | 96 hr | 7 day | 14 day (to be determined) |
| 1 | X | | | | X | | | X | | | |
| 2 | | X | | | | X | | | X | | |
| 3 | | | X | | | | X | | | X | X |
| 4 | X | | | X | | | | X | | | |
| 5 | | X | | | X | | | | X | | |
| 6 | | | X | | | X | | | | X | X |
| 7 | X | | | X | | | X | | | | |
| 8 | | X | | | X | | | X | | | |
| 9 | | | X | | | X | | | X | | |
| 10 | | | | X | | | X | | | X | X |

Vehicle Group 1 animals were bled terminally once, 1 hr post dose administration, as presented in Table 9, below.

TABLE 9

| Rat ID | Group 1<br>1 hr |
|---|---|
| 1 | X |
| 2 | X |
| 3 | X |

Resulting serum samples were analyzed via Alpha Klotho Human Soluble ELISA kit.

Table 10 presents a summary of study animals.

TABLE 10

| Species/Strain/Sex | Age Range | Total Number of Animals | Number of Animals per Group | Number of Groups |
|---|---|---|---|---|
| Rat/Sprague Dawley/M | 8-11 weeks | 63 | 3-10 | 7 |

Table 11 presents a summary of study design.

TABLE 11

| Group | Test Article | Dose Level µg/kg |
|---|---|---|
| 1 | PBS, pH 7.2 | — |
| 2 | Alpha Human Native Klotho | 10 |
| 3 | Alpha Human Native Klotho | 30 |
| 4 | Alpha Human Native Klotho | 100 |
| 5 | Alpha Human Fc-Fusion Klotho | 3 |
| 6 | Alpha Human Fc-Fusion Klotho | 10 |
| 7 | Alpha Human Fc-Fusion Klotho | 30 |

For Group Assignment: Stratified Sampling, a non-optimized randomization method that uses "binning" of the animals with measurement values of similar size was used. By this method, the pool of animals are stratified by sorting them by the measurement value of interest in ascending order. Animals are then organized into "bins" or strata according to the size of the measurement value. The number of strata is determined by the number of animals that are to be assigned per group. For example, if there are three animals per group, then three bins would be created: small, medium and large. One animal from each size bin is assigned randomly to each group. Stratified sampling ensures that each group receives one animal randomly from each size bin and the means of each group will remain similar to the other groups. This method balances differences between group means and standard deviations and controls for pool order bias.

For Statistical Analyses, Descriptive statistics were generated from Study data. Data were assessed to determine whether parametric or non-parametric analysis was appropriate. For parametric data, analysis of variance (ANOVA) followed by post-hoc tests was performed to determine significant differences between treatments, time points, and/or groups. For non-parametric data, appropriate statistical analyses was performed (e.g., Kaplan-Meier Survival, Kruskal-Wallis One-way ANOVA, Mann-Whitney or Wilcoxon Rank Sum, etc.).

Table 12 summarizes sample collection procedure.

TABLE 12

| Task | Method & Collection | Sample Info/Special Instructions |
|---|---|---|
| Serum preparation for PK sampling | Blood collected via saphenous vein or cardiac puncture into non-heparinized tubes for serum | Samples processed to serum and stored at −80 C. prior to ELISA analysis |

Table 13 summarizes sample collection tasks.

TABLE 13

| Task | Frequency |
|---|---|
| Body weight | On Study Day −1 and twice weekly thereafter |
| Clinical Observation | 2x weekly |
| Mortality Observation | As required |

Any animal whose body weight dropped below 85% of initial body weight or displays severe, prolonged adverse clinical signs was to be euthanized. Animals were to be euthanized via cardiac bleed for collection of plasma, serum and whole blood as indicated above.

Example 5

A study to determine Dose-Dependent Effects of Alpha Human Fc-Klotho and Alpha Human Native Klotho on I/R Induced-AKI and Renal Biomarkers (by measuring renal FR-induced increases in plasma renal injury biomarkers) in Wistar Rats was performed. Specifically, the objective of this study was to evaluate the dose-dependent effects Alpha human Fc-Klotho and Alpha Human Native Klotho on renal FR-induced increases in plasma renal injury biomarkers in rats. The study was designed to provide data from or related to Bilateral renal ischemia-reperfusion (FR) injury (30' ischemia duration) surgery (n=63) verses sham surgery (n=4), Compound dosing (one i.v. injection/rat), Serial urine collections via metabolic cage housing (3 collections/rat; D1, D2 & D7), Clinical chemistry analysis of serial urine specimens for creatinine and protein (D1, D2 & D7), Serial blood collections (3 collections/rat; D1, D2 & D7), Clinical chemistry analysis of serial plasma specimens for creatinine and BUN (D1, D2 & D7), Daily body weights and health observations post-surgery through endpoint, and Endpoint tissue collection and processing, with Data delivery in tabular, graphical, and presentation-ready PowerPoint format.

In addition, Analysis of serial urine specimens for Kim-1 via species specific ELISA (D1, D2 & D7), Analysis of serial urine specimens for NGAL via species specific ELISA (D1, D2 & D7), Left and/or Right Kidney mRNA Expression Analysis (1-2 kidney/animal: n=67 samples; 10 analytes, includes 3 normalization genes; performed using the Affymetrix Quantigene Plex 2.0 platform); MCP-1, TGF-β, α-SMA, Col1A1, Col3A1, Fn-1, CTGF), and Left and/or Right Renal Cortical Immunohistochemistry and Quantitation of Macrophage Infiltration via specific staining and quantitation of ED-1+ macrophage staining were also optionally performed.

Table 14 presents that study parameters.

TABLE 14

| | |
|---|---|
| Compounds: | Alpha Human Fc-Klotho: 10 or 30 μg/kg |
| | Alpha human Native Klotho: 10 or 30 μg/kg |
| Route/ | Alpha Human Fc-Klotho: i.v./dose once at either t − 0.5 |
| Frequency: | hour or t + 1 hour relative to time of ischemia inception |
| | Native Klotho: i.v./dose once at either t − 0.5 hour or |
| | t + 1 hour relative to time of ischemia inception |
| Vehicle/Dose | Alpha Human Fc-Klotho: PBS/1 ml/kg i.v. |
| Volume: | Native Klotho: PBS/1 ml/kg i.v. |
| Compound | Alpha Human Fc-Klotho: 0.221 mg |
| Requirement: | Native Klotho: 0.221 mg |

Table 15 presents a summary of study design.

TABLE 15

| Group | N/group (Animal #s) | Compound & Administration Interval (0 hr = time of ischemia inception) | Dose Volume & Route | Challenge |
|---|---|---|---|---|
| 1 | N = 4 (4528-4531) | Vehicle +1 Hr. | 1 ml/kg i.v. | Sham operated 7 Days Post-Sx |
| 2 | N = 9 (4532-4540) | Vehicle +1 Hr. | 1 ml/kg i.v. | 30' Ischemia 7 Days Reperfusion |
| 3 | N = 9 (4541-4549) | 10 μg/kg Fc-Klotho +1 Hr. | 1 ml/kg i.v. | 30' Ischemia 7 Days Reperfusion |
| 4 | N = 9 (4550-4558) | 30 μg/kg Fc-Klotho +1 Hr. | 1 ml/kg i.v. | 30' Ischemia 7 Days Reperfusion |
| 5 | N = 9 (4559-4567) | 10 μg/kg Native Klotho +1 Hr. | 1 ml/kg i.v. | 30' Ischemia 7 Days Reperfusion |
| 6 | N = 9 (4568-4576) | 30 μg/kg Native Klotho +1 Hr. | 1 ml/kg i.v. | 30' Ischemia 7 Days Reperfusion |
| 7 | N = 9 (4577-4585) | 30 μg/kg Fc-Klotho −0.5 Hr. | 1 ml/kg i.v. | 30' Ischemia 7 Days Reperfusion |
| 8 | N = 9 (4586-4594) | 30 μg/kg Native Klotho −0.5 Hr. | 1 ml/kg i.v. | 30' Ischemia 7 Days Reperfusion |

Sixty-seven (67) male Wistar rats weighing approximately 151-175 g were acquired and fed a standard chow diet (Harlan 8640), group housed under standard conditions, and allowed to acclimate for at least 7 days before enrolling in study. Prior to study inception, the study rats were placed into weight-matched treatment groups. Animals were enrolled to study using a balanced design, such that approximately equal numbers of animals were enrolled per group per surgical day, and the heaviest animals enrolled first to minimize differences in animal age. When not in metabolic cage housing, rats were group housed under standard conditions in static caging.

At t-0.5 hours, study rats were anesthetized with isoflurane anesthesia on a nosecone, prepared for surgery and core temperature allowed to equilibrate prior to renal FR operative procedure. Rats were administered 10 ml/kg warm, sterile saline (s.c.; 25% pre- and 75% post-surgery) to minimize perturbations in body fluid volume. Core temperature were maintained normative (37±0.2° C.) throughout ischemia duration. At t-0.5 hours, animals in Groups 7 and 8 also received an i.v. injection of compound as appropriate.

A laparotomy was then performed. At to, rats were subjected to either sham (Group 1, n=4) or bilateral renal arterial ischemia (Groups 2-8; n=9/grp) using heat sterilized instruments, PBI's proprietary vascular occlusive clamps, and aseptic surgical technique. Following thirty (30) minutes of continuous ischemia time (t+0.5), the occlusive clamps were removed, the kidneys reperfused and the abdominal wound closed with sterile silk suture. Rats were administered 0.01 mg/kg buprenorphine as post-operative analgesic and allowed to recover briefly in a clean, heated cage. At t+1 hour, rats in Groups 1-6 were briefly restrained and receive an i.v. injection of vehicle or Klotho compound in vehicle as appropriate. Rats in Groups 7 and 8 were also briefly restrained (but not injected) to control for handling stress. Rats were then immediately placed into metabolic cage.

Twenty-four (24) hours following reperfusion (D1), all animals had urine volumes determined and sampled. All animals then had blood (500 μl) collected on Li-Heparin by direct tail vein stick under conscious. Immediately post-bleed, rats received 500 μl warm saline. Urine and blood collection was repeated again on D2 (48 hours post-reperfusion) and D7 (168 hours post-reperfusion). On D2-D5, all rats were grouped housed under standard conditions in static caging and weighed, and underwent health observations daily. Whole blood (500 μl) was processed appropriately for the production of plasma and processed as described.

Clinical Observations were conducted once daily following inception of dosing. With regard to Data/Tissues to be Collected/Calculated, Animal Health was observed daily following surgical procedure, and Kidney mass (Left and Right Kidney weights) was indexed to tibia length and body weight. Urine was collected at D1, D2 and D7 (targeting n=3 samples/animal; 500 μl/sample). At least one sample was subjected to clinical chemistry analysis (creatinine, protein) by PBI and at least one sample was optionally used for Kim-1 and NGAL analysis. Plasma was collected on Li-Heparin at D1, D2 and D7 (targeting n=2 samples/animal; 125 μl/sample). At least one sample was subjected to clinical chemistry analysis (creatinine, BUN) by PBI.

On D7, rats were anesthetized with isoflurane immediately following bleed and tissues were harvested. Both left and right kidneys were immediately placed in ice-cold 0.9% NaCl, de-encapsulated and weighed. After tissue harvest (for histological and other analysis), all remaining inner cortical/outer medullary (i.e. S3/THAL enriched) from each sham and ischemic kidney (left and right kidney from each animal; 1 tube/kidney/animal) were snap frozen in appropriately labeled tube and stored at −80° C. for future potential biochemical analysis. Prior to any analyses being performed, cortical tissue was optionally cryogenically powdered and mixed to enable better homogeneity of the tissue sample across biochemical assays as well as limit introduction of sampling bias that may occur with cortical biopsies. At least one mid-transverse section of each sham and ischemic kidney (left and right from each animal) was optionally collected and immersion fixed in 10% neutral buffered formalin for histological analysis. The rats were then sacrificed.

Example 6

The body weight of study rats were measured to test for the effect of Klotho protein administration on subjects. Table 16 presents a summary of study animals.

TABLE 16

| Group | Test Article |
| --- | --- |
| Group 01 | Vehicle only, PBS, pH 7.2 |
| Group 02 | Alpha Human Native Klotho, 10 μg/kg |
| Group 03 | Alpha Human Native Klotho, 30 μg/kg |
| Group 04 | Alpha Human Native Klotho, 100 μg/kg |
| Group 05 | Alpha Human Fc-Fusion Klotho, 3 μg/kg |

TABLE 16-continued

| Group | Test Article |
| --- | --- |
| Group 06 | Alpha Human Fc-Fusion Klotho, 10 μg/kg |
| Group 07 | Alpha Human Fc-Fusion Klotho, 30 μg/kg |

Figure 9:
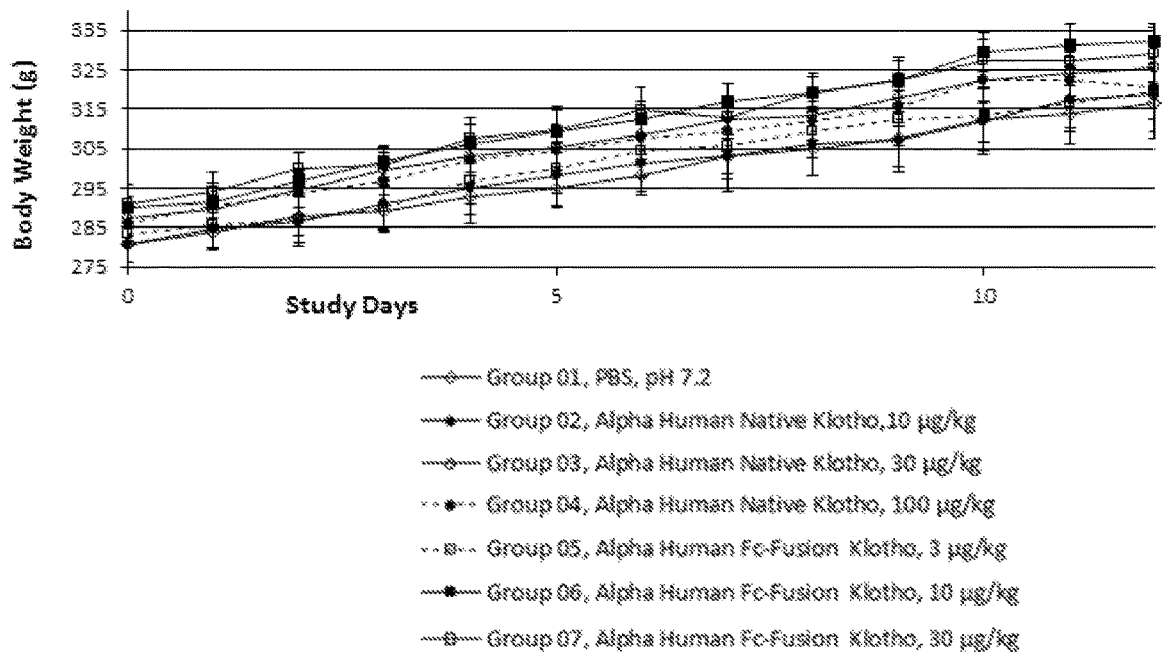
FIG. 9 is a graphical representation of the (daily) change in average body weight (+/− standard error of the mean; SEM bars) of rats in each of the indicated groups over the course of a 12-day study.

FIG. 9 illustrates, graphically, the average (mean) body weight (+/− standard error of the mean; SEM bars) of rats in each group over the course of the 12-day study (daily). Table 17, below, presents the corresponding data for mean body weight illustrated in FIG. 9, Table 18, below, presents the corresponding SEM illustrated in FIG. 9, and Table 19, below, presents the percent change in mean body weight of rats in each group over the course of the 12-day study (daily).

Example 7

To study the therapeutic effect of Klotho administration on Acute Kidney Injury (AKI) following renal ischaemia reperfusion injury (IRI), Sprague—Dawley rats were randomly divided into either Sham or AKI groups, and the animals in each group were randomly allocated into vehicle or Klotho treatment. In humans, AKI is a formidable clinical problem resulting primarily from ischemia or nephrotoxins, with outcomes ranging from full recovery to the development of chronic kidney disease with dialysis dependence, or death. Animals in the Klotho group received one bonus intraperitoneal injection of recombinant mouse Klotho protein (0.01 mg/kg body weight) 30 or 60 min after reperfusion; rats in vehicle group received the same volume of Klotho buffer (150 mM NaCl and 10 mM HEPES pH 7.4). Twenty-four-hour urine and blood were collected on days 1, 2, and 7 after surgery. This study showed that a single bolus injection of murine S-Klotho 30 min post-injury was effective in attenuating (AKI) in animal model of the human condition.

Example 8

To determine whether Klotho protects the lung against oxidant injury, Sprague-Dawley rats (body weight ~300 g) were exposed to normoxia (N: 21% inspired O) or hyperoxia (H: 90% O) for 3 d while receiving intra-peritoneal 2 2 injections of one of 3 preparations: Dulbeco's modified Eagle's Medium (DMEM) or conditioned medium (CM) from CHO cells overexpressing either Klotho (Klotho CM; ~60 pmol) or empty vector (Control CM) (n=6-8 animals each). Injections were given 12 h before, and repeated at 24 h and 48 h during exposure.

Also, 3LL cells were transplanted at the flanks of athymic mice by subcutaneous injection ($2 \times 10^6$ cells per mouse) and treated with Klotho protein (0.01 mg/kg, intraperitoneal) or vehicle every other day for 10 days. Lungs were harvested 21 days after transplantation and the number of metastatic nodules was counted.

TABLE 17

| Group | Day 0 | Day 1 | Day 2 | Day 3 | Day 4 | Day 5 | Day 6 | Day 7 | Day 8 | Day 9 | Day 10 | Day 11 | Day 12 |
| --- | --- | --- | --- | --- | --- | --- | --- | --- | --- | --- | --- | --- | --- |
| 1 | 280.67 | 283.93 | 287.87 | 288.93 | 292.63 | 295.00 | 298.30 | 302.90 | 305.03 | 307.30 | 312.27 | 313.63 | 316.47 |
| 2 | 280.40 | 284.77 | 286.40 | 290.77 | 294.77 | 298.07 | 301.20 | 303.23 | 306.33 | 307.00 | 311.97 | 317.33 | 318.80 |
| 3 | 287.23 | 289.47 | 294.67 | 299.60 | 302.83 | 305.23 | 308.37 | 312.47 | 313.47 | 317.77 | 322.17 | 323.93 | 325.27 |
| 4 | 285.83 | 290.43 | 293.50 | 296.73 | 302.30 | 304.50 | 307.40 | 309.27 | 311.93 | 315.53 | 322.17 | 322.43 | 320.70 |
| 5 | 283.10 | 285.50 | 287.10 | 290.07 | 296.93 | 300.00 | 304.53 | 305.77 | 309.17 | 312.63 | 313.30 | 316.67 | 319.53 |
| 6 | 290.23 | 291.37 | 296.53 | 301.50 | 306.17 | 309.33 | 312.30 | 316.93 | 319.03 | 322.17 | 329.43 | 331.30 | 332.30 |
| 7 | 291.10 | 294.23 | 300.10 | 300.57 | 307.30 | 309.77 | 314.53 | 312.83 | 319.03 | 322.40 | 327.30 | 327.27 | 328.83 |

TABLE 18

| Group | Day 0 | Day 1 | Day 2 | Day 3 | Day 4 | Day 5 | Day 6 | Day 7 | Day 8 | Day 9 | Day 10 | Day 11 | Day 12 |
|---|---|---|---|---|---|---|---|---|---|---|---|---|---|
| 1 | 5.72 | 4.64 | 4.98 | 4.40 | 6.57 | 4.62 | 5.28 | 5.70 | 6.82 | 7.07 | 7.74 | 7.33 | 9.08 |
| 2 | 4.07 | 5.06 | 6.35 | 6.70 | 6.70 | 7.92 | 7.09 | 9.12 | 8.13 | 8.21 | 8.56 | 8.06 | 9.33 |
| 3 | 5.55 | 3.71 | 4.83 | 4.41 | 4.56 | 5.05 | 6.27 | 4.94 | 6.20 | 6.20 | 5.87 | 5.52 | 6.57 |
| 4 | 2.97 | 5.81 | 5.20 | 5.44 | 5.78 | 5.88 | 6.53 | 4.92 | 4.91 | 4.90 | 5.23 | 5.47 | 5.69 |
| 5 | 6.92 | 5.68 | 6.08 | 6.45 | 6.03 | 6.53 | 6.72 | 7.11 | 6.48 | 7.00 | 6.81 | 6.32 | 7.31 |
| 6 | 4.72 | 3.84 | 3.51 | 4.15 | 4.72 | 5.34 | 4.48 | 4.54 | 4.25 | 5.86 | 4.78 | 5.40 | 4.47 |
| 7 | 4.91 | 4.62 | 3.64 | 4.56 | 5.39 | 5.67 | 5.85 | 5.24 | 4.95 | 4.60 | 5.14 | 5.39 | 6.98 |

TABLE 19

| Group | Day 0 | Day 1 | Day 2 | Day 3 | Day 4 | Day 5 | Day 6 | Day 7 | Day 8 | Day 9 | Day 10 | Day 11 | Day 12 |
|---|---|---|---|---|---|---|---|---|---|---|---|---|---|
| 1 | 0.00% | 1.18% | 2.58% | 2.97% | 4.26% | 5.13% | 6.29% | 7.93% | 8.67% | 9.48% | 11.24% | 11.73% | 12.72% |
| 2 | 0.00% | 1.55% | 2.12% | 3.68% | 5.11% | 6.28% | 7.40% | 8.12% | 9.23% | 9.46% | 11.23% | 13.15% | 13.66% |
| 3 | 0.00% | 0.81% | 2.60% | 4.32% | 5.45% | 6.28% | 7.36% | 8.80% | 9.14% | 10.63% | 12.17% | 12.79% | 13.25% |
| 4 | 0.00% | 1.59% | 2.67% | 3.80% | 5.74% | 6.51% | 7.52% | 8.19% | 9.12% | 10.38% | 12.70% | 12.79% | 12.18% |
| 5 | 0.00% | 0.87% | 1.43% | 2.47% | 4.91% | 5.98% | 7.58% | 8.01% | 9.23% | 10.45% | 10.68% | 11.88% | 12.88% |
| 6 | 0.00% | 0.40% | 2.19% | 3.89% | 5.49% | 6.58% | 7.61% | 9.21% | 9.93% | 11.00% | 13.51% | 14.15% | 14.50% |
| 7 | 0.00% | 1.08% | 3.11% | 3.26% | 5.56% | 6.41% | 8.05% | 7.47% | 9.60% | 10.77% | 12.45% | 12.43% | 12.95% |

Example 9

This example includes an exemplary set of claims that define a scope of the disclosure. However, as provided herein, the scope of the invention is indicated by the appended claims rather than by the forthcoming examples or foregoing description.

1. An exemplary method of manufacturing recombinant Klotho protein, the method comprising: producing a recombinant Klotho protein in Chinese hamster ovary (CHO) cells, preferably in dihydrofolate reductase (DHFR)-deficient CHO cells, more preferably in CHO—S cells, or preferably in glutamine synthetase (GS)-deficient CHO cells, more preferably in GS −/− CHO cells, the protein preferably having at least 80% amino acid sequence identity to at least a portion of one of SEQ ID NO: 2 through SEQ ID NO: 70 or SEQ ID NO: 107 through SEQ ID NO: 120.

2. The method of claim 1, wherein the protein comprises one or more glycans attached thereto.

3. The method of claim 1 or 2, wherein the CHO cells contain an exogenous nucleic acid that encodes: a promoter, preferably a strong promoter; a polypeptide with at least 80% amino acid sequence identity to at least a portion of one of SEQ ID NO: 2 through SEQ ID NO: 70 or SEQ ID NO: 107 through SEQ ID NO: 120; and optionally, a functional dihydrofolate reductase (DHFR) enzyme or a functional glutamine synthetase (GS) enzyme, wherein producing the recombinant Klotho protein comprises expressing the polypeptide encoded by the nucleic acid.

4. The method of claim 3, further comprising one or more steps selected from: introducing the exogenous nucleic acid into the CHO cells, preferably via transfection; and growing the CHO cells in a liquid medium, preferably in a serum-free and/or animal protein component-free medium, wherein the liquid medium preferably comprises a carbon source, a nitrogen source, and one or more vitamins, minerals, salts, amino acids, supplements, or additives, more preferably wherein the liquid medium lacks hypoxanthine, thymidine, and/or glutamine.

5. The method of claim 4, wherein the protein is secreted from the CHO cells into the liquid medium, preferably to a concentration of 200-500 mg of protein, more preferably to a concentration of 500-2000 mg of protein, still more preferably to a concentration of 2000-5000 mg of protein, per liter of liquid medium, without concentrating the protein.

6. The method of claim 4, further comprising introducing an effective amount of methotrexate (MTX) and/or methionine sulphoximine (MSX) into the liquid medium, preferably to a concentration of about 1 nM-1 µM, more preferably to a concentration of about 10-100 nM.

7. The method of claim 4, further comprising selecting a suspension culture of viable CHO cells growing in the liquid medium, wherein the concentration of the protein in the medium of the selected suspension culture is at least 200 mg/L, preferably at least 500 mg/L, more preferably at least 1000 mg/L, even more preferably at least 2000 mg/L, still more preferably at least 5000 mg/L, without concentrating the protein.

8. The method of claim 7, wherein the viable CHO cells of the selected suspension culture contain at least about 2 to 10 copies, preferably at least about 10 to 20 copies, more preferably at least about 20 to 30 copies, even more preferably at least about 30 to 50 copies of the exogenous nucleic acid per cell.

9. The method of claim 4, further comprising purifying a recombinant Klotho protein-containing extract from the CHO cells, liquid medium, or both, the extract preferably comprising: at least about 98% the protein, dry weight; and/or less than about 1-100 ppm CHO host cell proteins (HCP).

10. The method of claim 9, wherein purifying the extract maintains glycosylation of the protein.

11. The method of claim 4, wherein growing the CHO cells comprises culturing the CHO cells in a bioreactor having a volume or working volume of at least 10 liters, preferably at least 25 liters, more preferably at least 50 liters, even more preferably at least 100 liters, still more preferably at least 250 liters, still more preferably at least 500 liters, still more preferably at least 1,000 liters, still more preferably at least 2,000 liters, still more preferably at least 2,500 liters, still more preferably at least 5,000 liters, still more preferably at least liters.

12. The method of any one of claims 1 to 11, wherein the nucleic acid comprises a transgene or cDNA, at least a portion of which preferably having at least 80%, more preferably at least 90%, even more preferably at least 95%, still more preferably at least 98%, still more preferably at least 99%, most preferably 100% nucleic acid sequence identity to at least a portion of one or more of SEQ ID NO: 76 through SEQ ID NO: 106 or SEQ ID NO: 121 through SEQ ID NO: 124.

13. The method of any one of claims 1 to 12, wherein the protein has at least 90%, preferably at least 95%, more preferably at least 98%, even more preferably at least 99%, most preferably 100% amino acid sequence identity to at least a portion of one of SEQ ID NO: 2 through SEQ ID NO: 70 or SEQ ID NO: 107 through SEQ ID NO: 120.

14. A cell line, comprising: a plurality of Chinese hamster ovary (CHO) cells, preferably in dihydrofolate reductase (DHFR)-deficient CHO cells, more preferably in CHO—S cells, or preferably in glutamine synthetase (GS)-deficient CHO cells, more preferably in GS −/− CHO cells, the CHO cells containing an exogenous nucleic acid comprises a promoter, preferably a strong promoter, and encodes: a polypeptide, at least a portion of the polypeptide having at least 80% amino acid sequence identity to at least a portion of one of SEQ ID NO: 2 through SEQ ID NO: 70 or SEQ ID NO: 107 through SEQ ID NO: 120; and optionally, a functional dihydrofolate reductase (DHFR) enzyme or a functional glutamine synthetase (GS) enzyme.

15. The cell line of claim 14, wherein the CHO cells contain or are selected to contain at least about 2 to 10 copies, preferably at least about 10 to 20 copies, more preferably at least about 20 to 30 copies, even more preferably at least about 30 to 50 copies of the exogenous nucleic acid per cell.

16. The cell line of claim 14, wherein the nucleic acid encodes a polypeptide with at least 90%, preferably at least 95%, more preferably at least 98%, even more preferably at least 99%, most preferably 100% amino acid sequence identity to at least a portion of one of SEQ ID NO: 2 through SEQ ID NO: 70 or SEQ ID NO: 107 through SEQ ID NO: 120.

17. The cell line of claim 14, wherein the nucleic acid comprises a transgene or cDNA, preferably having at least 80%, more preferably at least 90%, even more preferably at least 95%, still more preferably at least 98%, still more preferably at least 99%, most preferably 100% nucleic acid sequence identity to one of SEQ ID NO: 76 through SEQ ID NO: 106 or SEQ ID NO: 121 through SEQ ID NO: 124.

18. A suspension cell culture, comprising: a liquid medium, preferably a serum-free and/or animal protein component-free liquid medium, wherein the liquid medium preferably comprises a carbon source, a nitrogen source, and one or more vitamins, minerals, salts, amino acids, supplements, or additives, more preferably wherein the liquid medium lacks hypoxanthine, thymidine, and/or glutamine; and the cell line of any one of claims 14-17 growing in the liquid medium such that the CHO cells express the polypeptide encoded by the nucleic acid, the polypeptide comprising a recombinant Klotho protein.

19. The suspension cell culture of claim 18, wherein the CHO cells secrete the protein into the liquid medium, preferably to a concentration of 200-500 mg of protein, more preferably to a concentration of 500-2000 mg of protein, still more preferably to a concentration of 2000-5000 mg of protein, per liter of liquid medium, without concentrating the protein, and/or wherein the protein is present in the liquid medium at a concentration of 200-500 mg of protein, more preferably to a concentration of 500-2000 mg of protein, still more preferably to a concentration of 2000-5000 mg of protein, per liter of liquid medium, without concentrating the protein.

20. The suspension cell culture of claim 18 or 19, wherein the protein comprises one or more glycans attached thereto.

21. The suspension cell culture of any one of claims 18 to 20, wherein the liquid medium further comprises an effective amount of methotrexate (MTX) and/or methionine sulphoximine (MSX), preferably at a concentration of about 1 nM-1 μM, more preferably at a concentration of about 10 nM-100 nM.

22. The suspension cell culture of any one of claims 18 to 21, wherein the protein has at least 80%, preferably at least 90%, more preferably at least 95%, even more preferably at least 98%, still more preferably at least 99%, most preferably 100% amino acid sequence identity to at least a portion of one of SEQ ID NO: 2 through SEQ ID NO: 70 or SEQ ID NO: 107 through SEQ ID NO: 120.

23. A recombinant Klotho protein, wherein at least a portion of the protein has at least 80% amino acid sequence identity to at least a portion of one of SEQ ID NO: 2 through SEQ ID NO: 70 or SEQ ID NO: 107 through SEQ ID NO: 120.

24. The recombinant Klotho protein of claim 23, wherein the protein: modulates the IGF-1 and/or Wnt signaling pathways; exhibits β-glucuronidase and/or sialidase activity; suppress the p53/p21 signaling pathway; and/or reduces H2O2-induced cell senescence and apoptosis, preferably through suppression of the p53/p21 signaling pathway.

25. The recombinant Klotho protein of claim 23 or 24, wherein the protein is functional as a humoral factor, preferably exhibiting pleiotropic activity, preferably in the regulation of oxidative stress, growth factor signaling, ion homeostasis, and/or regulation of activity of one or more glycoproteins on the cell surface, preferably one or more ion channel proteins and/or growth factor receptors, preferably Insulin/Insulin-Like Growth Factor-1 receptor.

26. The recombinant Klotho protein of any one of claims 23 to 25, wherein at least a portion of the protein has at least 80%, preferably at least 90%, more preferably at least 95%, even more preferably at least 98%, still more preferably at least 99%, most preferably 100% amino acid sequence identity to at least a portion of one of SEQ ID NO: 2 through SEQ ID NO: 70 or SEQ ID NO: 107 through SEQ ID NO: 120.

27. A method of treating an aging-related or other condition, disease, or disorder, the method comprising administering to a subject in need thereof a pharmaceutically effective amount of the recombinant Klotho protein of any one of claims 23 to 26.

28. A method of treating an aging-related or other condition, disease, or disorder, the method comprising administering to a subject in need thereof a pharmaceutically effective amount of a soluble recombinant Klotho protein having at least 80% amino acid sequence identity to at least a subset of amino acid residues 1-981 of human alpha Klotho isoform 1.

29. A method of treating an aging-related or other condition, disease, or disorder, the method comprising administering to a subject in need thereof a pharmaceutically effective amount of a soluble recombinant Klotho protein having at least 80% amino acid sequence identity to at least a portion of one of SEQ ID NO: 2 through SEQ ID NO: 70 or SEQ ID NO: 107 through SEQ ID NO: 120.

30. The method of any one of claims 27 to 29, wherein the protein has at least 80%, preferably at least 90%, more preferably at least 95%, even more preferably at least 98%, still more preferably at least 99%, most preferably 100% amino acid sequence identity to at least a portion of one of SEQ ID NO: 2 through SEQ ID NO: 70 or SEQ ID NO: 107 through SEQ ID NO: 120.

31. The method of claim 30, wherein the pharmaceutically effective amount is sufficient to: raise the serum soluble Klotho protein concentration of the subject to a predetermined level; and preferably maintain the serum soluble Klotho protein concentration of the subject at or above a predetermined threshold for a predetermined period of time.

32. The method of claim 31, wherein the predetermined level is greater than or equal to about 1000 picograms of soluble Klotho protein per milliliter of serum.

33. The method of claim 31, wherein the predetermined level is greater than, equal to, or between about: 50, 100, 250, 500, 750, 1000, 1250, 1500, 1750, 2000, 2250, 2500, 2750, 3000, 3500, 4000, 4500, 5000, 5500, 6000, 6500, 7000, 7500, 8000, 8500, 9000, 9500, 11,000, 12,000, 13,000, 14,000, 15,000 20,000, 25,000, 30,000 40,000, 50,000, or 100,000 picograms of soluble Klotho protein per milliliter of serum; and/or 5%, 10%, 15%, 20%, 25%, 30%, 40%, 50%, 60%, 70%, 80%, 90%, 100%, 150%, 200%, 250%, 300%, 400%, 500%, 600%, 700%, 800%, 900%, 1000%, 1200%, 1500%, 2000%, 2500%, 3000%, 4000%, or 5000%, greater than typical healthy levels of soluble Klotho protein in serum.

34. The method of claim 31, further comprising one or more of: determining a serum soluble Klotho protein concentration of the subject; calculating a pharmaceutically effective amount of the protein sufficient to raise the serum soluble Klotho protein concentration of the subject to a first predetermined level, wherein the first predetermined level is preferably greater than or equal to about 1000 picograms of soluble Klotho protein per milliliter of serum; determining a rate of soluble Klotho protein decline and/or metabolism in the serum of the subject; calculating a subsequent dosage time at which the serum soluble Klotho protein concentration of the subject will be at or below a second predetermined level based on the determined rate; and calculating a subsequent dosage amount of the protein sufficient to raise the serum soluble Klotho protein concentration of the subject from the second predetermined level to the first predetermined level.

35. The method of claim 34, further comprising administering the subsequent dosage amount of the protein to the subject.

36. The method of claim 31, further comprising one or more of: introducing an exogenous nucleic acid into Chinese hamster ovary (CHO) cells, preferably via transfection, the nucleic acid preferably comprising a transgene or cDNA, the nucleic acid encoding a polypeptide with at least 80%, preferably at least 90%, more preferably at least 95%, even more preferably at least 98%, still more preferably at least 99%, most preferably 100% amino acid sequence identity to at least a portion of one of SEQ ID NO: 2 through SEQ ID NO: 70 or SEQ ID NO: 107 through SEQ ID NO: 120, the nucleic acid preferably having at least 80%, more preferably at least 90%, even more preferably at least 95%, still more preferably at least 98%, still more preferably at least 99%, most preferably 100% nucleic acid sequence identity to one of SEQ ID NO: 76 through SEQ ID NO: 106 or SEQ ID NO: 121 through SEQ ID NO: 124; growing the CHO cells in a liquid medium, preferably in a serum-free and/or animal protein component-free liquid medium, wherein the liquid medium preferably comprises a carbon source, a nitrogen source, and one or more vitamins, minerals, salts, amino acids, supplements, or additives, more preferably wherein the liquid medium lacks hypoxanthine, thymidine, and/or glutamine, the CHO cells preferably being: dihydrofolate reductase (DHFR)-deficient CHO cells, more preferably in CHO—S cells, or glutamine synthetase (GS)-deficient CHO cells, more preferably in GS −/− CHO cells; introducing an effective amount of methotrexate (MTX) and/or methionine sulphoximine (MSX) into the liquid medium, preferably to a concentration of about 1 nM-1 µM, more preferably to a concentration of about 10-100 nM; selecting through cell selection process a suspension culture of viable CHO cells growing in the liquid medium, wherein the concentration of the protein in the medium of the selected suspension culture is at least 200 mg/L, preferably at least 500 mg/L, more preferably at least 1000 mg/L, even more preferably at least 2000 mg/L, still more preferably at least 5000 mg/L, without concentrating the protein; producing the recombinant soluble Klotho protein in the CHO cells, wherein the protein is preferably secreted from the CHO cells into the liquid medium, preferably to a concentration of 200-500 mg of protein, more preferably to a concentration of 500-2000 mg of protein, still more preferably to a concentration of 2000-5000 mg of protein, per liter of liquid medium, without concentrating the protein; and purifying a recombinant soluble Klotho protein-containing extract from the CHO cells, liquid medium, or both, the extract preferably comprising: at least about 98% dry weight of the recombinant soluble Klotho protein; and/or less than about 1-100 ppm CHO host cell proteins (HCP), wherein purifying the extract preferably maintains glycosylation of the protein, the protein having one or more glycans attached thereto.

37. The method of claim 31, wherein the predetermined period of time is at least about 6 hours, preferably at least about 12 hours, more preferably at least about 18 hours, even more preferably at least about 24 hours, still more preferably at least about 30 hours, still more preferably at least about 36 hours, still more preferably at least about 42 hours, still more preferably at least about 48 hours, still more preferably at least about 54 hours, still more preferably at least about 60 hours, still more preferably at least about 66 hours, still more preferably at least about 72 hours.

38. The method of claim 31, wherein the predetermined period of time is greater than or equal to about 1-120 days.

39. The method of claim 31, wherein the predetermined period of time is greater than or equal to about 6 months, 9 months, or 1 year.

40. The method of any one of claims 30 to 39, wherein the subject is a human, a non-human animal, or a non-human mammal.

41. The method of any one of claims 30 to 40, wherein the protein is administered in or with a pharmaceutically-acceptable carrier.

42. The method of any one of claims 30 to 41, wherein the aging-related or other condition, disease, or disorder comprises one or more of: frailty; bone density loss; bone mineral density loss; weight loss; muscular atrophy; muscular degeneration; decline in muscle mass; decline in muscle strength; decline in hand strength; decline in leg strength; decline in physical fitness; decline in movement; decline in freedom of movement; decline in quality of life assessment; decline in ejection fraction; decline in exercise capacity; decline in learning; decline in learning capacity; decline in memory; decline in intellectual quotient; cognitive deterioration; forgetfulness; decline in cognitive capacity; decline in cognitive function; decline in synaptic plasticity; decline in synaptic function; and cellular senescence.

43. The method of any one of claims 30-41, wherein the aging-related or other condition, disease, or disorder comprises one or more of: chronic kidney disease (CKD);

polycystic kidney disease (PKD); autosomal dominant polycystic kidney disease (ADPKD); acute kidney injury (AKI); acute tubular necrosis (ATN); acute allergic interstitial nephritis (AAIN); glomerulonephritis; kidney disease; renal failure; nonoliguric renal failure; alcoholism; hyperphosphatemia; muscular dystrophy (MS); type 1 diabetes; type 2 diabetes; cardiovascular disease (CVD); cardiovascular calcification; cerebrovascular insufficiency; vascular calcification; coronary artery disease; abnormalities in blood pressure; salt-sensitive hypertension; tissue calcification; calcific atherosclerotic plaque burden; calcinosis; familial tumoral calcinosis; cancer; one or more tumors; myelin-related diseases; demyelinating diseases; neurodegenerative disease; neurovascular diseases; progressive supranuclear palsy PSP); Pompe disease; Niemann-Pick disease; microgliosis; Farber disease (FD); bone mass diseases; osteoporosis; osteopenia; osteopenia (particularly loss of BMD of cortical bone); pulmonary emphysema; pulmonary fibrosis; skin atrophy; thymic atrophy; accumulation of renal interstitial matrix; glomerulosclerosis; anemia; albuminuria; proteinuria; infertility; Alzheimer's disease; Parkinson's Disease; dementia; vascular dementia; amyotrophic lateral sclerosis (ALS); motor neuron disease (MND); atrial fibrillation; chronic obstructive pulmonary disease (COPD); fibromyalgia; adult onset diabetes; arthritis; rheumatoid arthritis; osteoarthritis; glaucoma; cataracts; macular degeneration; multiple sclerosis (MS); lupus; ulcerative colitis; cachexia; obesity; vitamin D-related conditions; bone diseases; bone diseases through bone remodeling; stem cell depletion; sea sickness; space adaptation syndrome (SAS); nausea; and vertigo.

44. The method of any one of claims 30-43, further comprising administering or co-administering one or more additional active ingredients.

45. The method of claim 44, wherein the one or more additional active ingredients are selected from the group consisting of a drug, antibody, hormone, radiocontrast agent, medicament, natural compound, synthetic compound, or pharmaceutical composition.

46. A pharmaceutical composition, comprising: a pharmaceutically effective amount of the recombinant Klotho protein of any one of claims 23-25; and a pharmaceutically-acceptable carrier.

47. A pharmaceutical composition, comprising: a pharmaceutically effective amount of a recombinant soluble Klotho protein, at least a portion of the protein having at least 80% amino acid sequence identity to: at least a subset of amino acid residues 1-981, 29-981, 34-981, 36-981, 131-981, 1-549, 29-549, 34-549, 36-549, or 131-549 of human alpha Klotho isoform 1 or 2; or at least a portion of one of SEQ ID NO: 2 through SEQ ID NO: 70 or SEQ ID NO: 107 through SEQ ID NO: 120; and a pharmaceutically-acceptable carrier.

48. The pharmaceutical composition of claim 46 or 47, wherein at least a portion of the protein having at least 80%, preferably at least 88%, more preferably at least 90%, even more preferably at least 92%, still more preferably at least 95%, still more preferably at least 98%, still more preferably at least 99%, most preferably 100% amino acid sequence identity to at least a portion of one of SEQ ID NO: 2 through SEQ ID NO: 70 or SEQ ID NO: 107 through SEQ ID NO: 120.

49. The pharmaceutical composition of any one of claims 46 to 48, further comprising one or more additional active ingredients.

50. The pharmaceutical composition of any one of claims 46 to 49 for use in treating an aging-related or other condition, disease, or disorder comprising one or more of: frailty; bone density loss; bone mineral density loss; weight loss; muscular atrophy; muscular degeneration; decline in muscle mass; decline in muscle strength; decline in hand strength; decline in leg strength; decline in physical fitness; decline in movement; decline in freedom of movement; decline in quality of life assessment; decline in ejection fraction; decline in exercise capacity; decline in learning; decline in learning capacity; decline in memory; decline in intellectual quotient; cognitive deterioration; forgetfulness; decline in cognitive capacity; decline in cognitive function; decline in synaptic plasticity; decline in synaptic function; cellular senescence; chronic kidney disease (CKD); polycystic kidney disease (PKD); autosomal dominant polycystic kidney disease (ADPKD); acute kidney injury (AKI); acute tubular necrosis (ATN); acute allergic interstitial nephritis (AAIN); glomerulonephritis; kidney disease; renal failure; nonoliguric renal failure; alcoholism; hyperphosphatemia; muscular dystrophy (MS); type 1 diabetes; type 2 diabetes; cardiovascular disease (CVD); cardiovascular calcification; cerebrovascular insufficiency; vascular calcification; coronary artery disease; abnormalities in blood pressure; salt-sensitive hypertension; tissue calcification; calcific atherosclerotic plaque burden; calcinosis; familial tumoral calcinosis; cancer; one or more tumors; myelin-related diseases; demyelinating diseases; neurodegenerative disease; neurovascular diseases; progressive supranuclear palsy (PSP); Pompe disease; Niemann-Pick disease; microgliosis; Farber disease (FD); bone mass diseases; osteoporosis; osteopenia; osteopenia (particularly loss of BMD of cortical bone); pulmonary emphysema; pulmonary fibrosis; skin atrophy; thymic atrophy; accumulation of renal interstitial matrix; glomerulosclerosis; anemia; albuminuria; proteinuria; infertility; Alzheimer's disease; Parkinson's Disease; dementia; vascular dementia; amyotrophic lateral sclerosis (ALS); motor neuron disease (MND); atrial fibrillation; chronic obstructive pulmonary disease (COPD); fibromyalgia; adult onset diabetes; arthritis; rheumatoid arthritis; osteoarthritis; glaucoma; cataracts; macular degeneration; multiple sclerosis (MS); lupus; ulcerative colitis; cachexia; obesity; vitamin D-related conditions; bone diseases; bone diseases through bone remodeling; stem cell depletion; sea sickness; space adaptation syndrome (SAS); nausea; and vertigo.

51. The pharmaceutical composition of any one of claims 46 to 49 for use in treating or preventing acute kidney injury (AKI).

52. A method of treating or preventing acute kidney injury (AKI) or other condition, the method comprising: administering to a subject in need thereof a pharmaceutically effective amount of a recombinant Klotho protein, at least a portion of the protein having at least 80%, 86%, 88%, 90%, 92%, 95%, 98%, 99%, or preferably 100% amino acid sequence identity to: at least a subset of amino acid residues 1-981, 29-981, 34-981, 36-981, 131-981, 1-549, 29-549, 34-549, 36-549, or 131-549 of human alpha Klotho isoform 1 or 2; or at least a portion of one of SEQ ID NO: 2 through SEQ ID NO: 70 or SEQ ID NO: 107 through SEQ ID NO: 120.

53. The method of claim 52, further comprising co-administering one or more additional active ingredients with the pharmaceutically effective amount of recombinant soluble Klotho protein.

54. The method of claim 53, wherein the protein and one or more additional active ingredients are formulated into a combination product or composition.

55. The method of claim 53, wherein the protein and one or more additional active ingredients are separate compositions.

56. The method of claim 53, wherein the protein and one or more additional active ingredients are mixed.

57. The method of claim 53, wherein the protein and one or more additional active ingredients are configured for co-administration, wherein co-administration comprises: simultaneous administration; or distinct administrations, preferably separated by a period of time.

58. The method of claim 53, wherein the one or more additional active ingredients are selected from the group consisting of a drug, antibody, hormone, radiocontrast, medicament, or composition.

59. The method of claim 52 or 53, wherein the condition comprises: acute tubular necrosis (ATN), nephritis, acute allergic interstitial nephritis (AAIN), glomerulonephritis, and/or nephrotoxicity; or AKI resulting at least in part from kidney transplant or other surgery, acute tubular necrosis (ATN), nephritis, acute allergic interstitial nephritis (AAIN), glomerulonephritis, nephrotoxicity, or low blood pressure.

60. The method of claim 52 or 53, wherein the nephrotoxicity comprises drug-induced nephrotoxicity.

61. The method of claim 60, wherein the drug-induced nephrotoxicity comprises anti-microbial-induced nephrotoxicity.

62. The method of claim 60, wherein the drug-induced nephrotoxicity comprises aminoglycoside-induced nephrotoxicity.

63. The method of claim 52 or 53, wherein the step of administering comprises one or more steps select from the group consisting of: determining a serum soluble Klotho level in the subject; calculating a first dosage of the protein sufficient to raise the serum soluble Klotho level in the subject to a predetermined level or percent of normal levels; administering the first dosage of protein to the subject, preferably by bolus or gradual administration, more preferably by injection; determining a rate of soluble Klotho decline in the serum of the subject, preferably following administration of the first dosage; calculating a time and/or amount of a subsequent dosage of the protein; and administering the subsequent dosage of the protein to the subject in accordance with the calculated time and/or amount.

64. The method of claim 52 or 53, wherein the step of administering is sufficient to raise and/or maintain a serum soluble Klotho protein concentration of the subject at or above a predetermined level or threshold, optionally for a predetermined period of time.

65. The method of claim 64, wherein the predetermined level or threshold is greater than, equal to, and/or between about: 50, 100, 250, 500, 750, 1000, 1250, 1500, 1750, 2000, 2250, 2500, 2750, 3000, 3500, 4000, 4500, 5000, 5500, 6000, 6500, 7000, 7500, 8000, 8500, 9000, 9500, 10,000, 11,000, 12,000, 13,000, 14,000, 15,000 20,000, 25,000, 30,000 40,000, 50,000, or 100,000 picograms of soluble Klotho protein per milliliter of serum; or 5%, 10%, 15%, 20%, 25%, 30%, 40%, 50%, 60%, 70%, 80%, 90%, 100%, 150%, 200%, 250%, 300%, 400%, 500%, 600%, 700%, 800%, 900%, 1000%, 1200%, 1500%, 2000%, 2500%, 3000%, 4000%, or 5000% greater than typical healthy levels of soluble Klotho protein in serum.

66. The method of claim 64, wherein the predetermined period of time is greater than or equal to about 6 hours, 12 hours, 18 hours, 1 day, 2 days, 3 days, 4 days, 5 days, 6 days, 7 days, 8 days, 9 days, 10 days, 12 days, 14 days, 21 days, 30 days, 45 days, 60 days, 90 days, 120 days, 6 months, 9 months, 1 year, 2 years, 3 years, 4 years, or 5 years.

67. The method of claim 52 or 53, wherein the protein is administered: prophylactically, prior to kidney transplant or administration of a nephrotoxin; and/or following kidney transplant or administration of a nephrotoxin.

68. The method of claim 67, wherein the nephrotoxin comprises: one or more aminoglycosides, preferably selected from the group consisting of paromomycin, tobramycin, gentamicin, amikacin, kanamycin, and neomycin; one or more anti-fungal agents, preferably selected from the group consisting of amphotericin B and flucytosine; one or more contrast agents, preferably selected from the group consisting of iodinated radiocontrast media, high-osmolality contrast media (HOCM) having an iodine to molecule ratio of about 1.5:1, low-osmolality, nonionic contrast media (LOCM) having an iodine to molecule ratio of about 3:1, and isosmolar (isoosmolality) contrast media (IOCM) having an iodine to molecule ratio of about 6:1); one or more antiretroviral agents, preferably selected from the group consisting of adefovir, cidofovir, tenofovir, and foscarnet; one or more cancer (or chemo-) therapeutics, preferably selected from the group consisting of cisplatin, carboplatin, oxaliplatin, an alkylating agent, bendamustine, cyclophosphamide, ifosfamide, nitrosoureas, temozolomide, melphalan, an antitumor antibiotic, mitomycin C, bleomycin, anthracyclines, an antimetabolites, capecitabine, hydroxyurea, methotrexate, pemetrexed, pralatrexate, pentostatin, fludarabine, cladribine, gemcitabine, cytarabine, *vinca* alkaloids, topotecan, etoposide, taxanes, irinotecan, lenalidomide, eribulin, arsenic trioxide, or ixazomib; one or more bisphosphonates, or derivatives thereof, preferably selected from the group consisting of zoledronate/zoledronic acid, ibandronate, alendronate, alendronate/cholecalciferol, etidronate, risedronate, risedronate calcium carbonate, pamidronate, and tiludronate; and/or one or more narcotics or opioids), preferably selected from the group consisting of cocaine and heroin.

69. The method of claim 52 or 53, wherein the protein comprises: C370S, preferably without F352V, more preferably with F352; and/or H193 or other than the H193R variant.

70. A method of treating an aging individual, the aging individual having a homozygous or heterozygous mutation in a gene encoding Klotho protein, the method comprising: administering a therapeutic concentration of a polypeptide having at least 80%, preferably at least 90%, more preferably at least 95%, even more preferably at least 98%, still more preferably at least 99%, most preferably 100% amino acid sequence identity to at least a portion of one of SEQ ID NO: 2 through SEQ ID NO: 70 or SEQ ID NO: 107 through SEQ ID NO: 120.

71. The method as in claim 70, further comprising determining a level of expression of the gene.

72. The method as in claim 71, wherein the step of administering the therapeutic concentration is dependent on the level of expression of the gene.

73. A method of treating and/or preventing acute kidney injury or chronic kidney disease in a mammalian subject, the method comprising:
  administering to the subject a pharmaceutical composition comprising:
  a pharmaceutically-acceptable carrier or excipient; and
  an effective amount of a recombinant fusion protein comprising:
  a Klotho protein sequence having at least 85% amino acid sequence identity to one of SEQ ID NO: 4, SEQ ID NO: 9, and SEQ ID NO: 109; and one or more synthetic protein sequences selected from the group consisting of:
at least a portion of an immunoglobulin Fc domain; and
at least a portion of a protease recognition sequence.

74. The method of claim 73, wherein the acute kidney injury is selected from the group consisting of:
(i) surgery- or other medical procedure-induced kidney damage, preferably kidney surgery-induced kidney damage, more preferably kidney transplant-induced kidney damage;
(ii) sepsis-induced kidney damage;
(iii) renal ischemia, preferably surgery- or other medical procedure-induced renal ischemia, more preferably:
kidney surgery-induced renal ischemia, preferably kidney transplant-induced renal ischemia; and/or
cardio-vascular surgery-induced renal ischemia, preferably aorta repair-, aneurism repair-, or heart surgery-induced renal ischemia, heart bypass surgery-induced renal ischemia, coronary artery bypass (graft) surgery-induced renal ischemia, and/or cardiopulmonary bypass surgery-induced renal ischemia; and/or
(iv) nephrotoxicity, preferably drug-induced nephrotoxicity, more preferably anti-microbial-induced nephrotoxicity or aminoglycoside-induced nephrotoxicity;

75. The method of claim 73 or 74, wherein the administering step comprises one or more of:
a bolus or gradual injection, preferably selected from intravenous, intradermal, intraperitoneal, intramuscular, intracutaneous, and subcutaneous injection;
an oral or oral-related administration, preferably selected from ingestion, buccal, and sublingual administration;
topical administration;
transdermal administration;
rectal administration;
vaginal administration; and
inhalation.

76. The method of one of claims 73-75, further comprising:
measuring a concentration of soluble Klotho protein in a bodily fluid of the subject; and
calculating a first dosage of the composition sufficient to raise the concentration of soluble Klotho protein at least to a predetermined level and/or for a predetermined period of time, the administered composition comprising the first dosage.

77. The method of claim 76, further comprising:
measuring a rate of soluble Klotho protein concentration decline in a bodily fluid of the subject following the administering step;
calculating a time and/or amount of a subsequent dosage of the composition; and
administering the subsequent dosage of the composition to the subject in accordance with the calculated time and/or amount.

78. The method of one of claims 73-77, wherein each administering step is sufficient to raise and/or maintain a concentration of soluble Klotho protein in the bodily fluid of the subject at least to a predetermined level and/or for a predetermined period of time.

79. The method of one of claims 76-78, wherein the predetermined level is greater than, equal to, and/or between about:
50, 100, 250, 500, 750, 1000, 1250, 1500, 1750, 2000, 2250, 2500, 2750, 3000, 3500, 4000, 4500, 5000, 5500, 6000, 6500, 7000, 7500, 8000, 8500, 9000, 9500, 10,000, 11,000, 12,000, 13,000, 14,000, 15,000 20,000, 25,000, 30,000 40,000, 50,000, 75,000, and/or 100,000 picograms of soluble Klotho protein per milliliter of the bodily fluid;
0.0001-10 mg/kg body weight of the subject, 0.0001-10 µg/kg body weight of the subject, 0.0001-10 ng/kg body weight of the subject, 0.0001-10 pg/kg body weight of the subject; or
5%, 10%, 15%, 20%, 25%, 30%, 40%, 50%, 60%, 70%, 80%, 90%, 100%, 150%, 200%, 250%, 300%, 400%, 500%, 600%, 700%, 800%, 900%, 1000%, 1200%, 1500%, 2000%, 2500%, 3000%, 4000%, or 5000% greater than a known, typical, healthy level of soluble Klotho protein in the bodily fluid for the subject.

80. The method of one of claims 76-79, wherein the predetermined period of time is greater than, equal to, or between about 6 hours, 12 hours, 18 hours, 1 day, 2 days, 3 days, 4 days, 5 days, 6 days, 7 days, 8 days, 9 days, 10 days, 12 days, 14 days, 21 days, or 30 days.

81. The method of one of claims 73-80, wherein the protein is administered:
prophylactically, prior to one or more of kidney surgery, kidney transplant, cardio-vascular surgery, heart bypass surgery, coronary artery bypass (graft) surgery, cardiopulmonary bypass surgery, and administration of a nephrotoxin; and/or
following one or more of kidney surgery, kidney transplant, cardio-vascular surgery, heart bypass surgery, coronary artery bypass (graft) surgery, cardiopulmonary bypass surgery, and administration of a nephrotoxin.

82. The method of claim 81, wherein the nephrotoxin comprises:
one or more aminoglycosides, preferably selected from the group consisting of paromomycin, tobramycin, gentamicin, amikacin, kanamycin, and neomycin;
one or more non-steroid anti-inflammatory drugs (NSAIDs), preferably selected from the group consisting of aspirin (acetylsalicylic acid), celecoxib, diclofenac, diflunisal, etodolac, ibuprofen, indomethacin, ketoprofen, ketorolac, nabumetone, naproxen, oxaprozin, piroxicam, salsalate, sulindac, and tolmetin;
one or more anti-microbial agents, preferably selected from the group consisting of penicillins, ampicillin, cephalosporins, sulfonamides, ciprofloxacin, vancomycin, macrolides, tetracyclines, and rifampin;
one or more anti-fungal agents, preferably selected from the group consisting of amphotericin B and flucytosine;
one or more contrast agents, preferably selected from the group consisting of iodinated radiocontrast media, high-osmolality contrast media (HOCM) having an iodine to molecule ratio of about 1.5:1, low-osmolality, nonionic contrast media (LOCM) having an iodine to molecule ratio of about 3:1, and isosmolar (isoosmolality) contrast media (IOCM) having an iodine to molecule ratio of about 6:1);
one or more antiretroviral agents, preferably selected from the group consisting of adefovir, cidofovir, tenofovir, and foscarnet;
one or more cancer (or chemo-) therapeutics, preferably selected from the group consisting of cisplatin, carboplatin, oxaliplatin, an alkylating agent, bendamustine, cyclophosphamide, ifosfamide, nitrosoureas, temozolomide, melphalan, an antitumor antibiotic, mitomycin C, bleomycin, anthracyclines, an antimetabolites, capecitabine, hydroxyurea, methotrexate, pemetrexed, pralatrexate, pentostatin, fludarabine, cladribine, gemcitabine, cytarabine, *vinca* alkaloids, topotecan, etoposide, taxanes, irinotecan, lenalidomide, eribulin, arsenic trioxide, or ixazomib;
one or more bisphosphonates, or derivatives thereof, preferably selected from the group consisting of zoledronate/zoledronic acid, ibandronate, alendronate, alendronate/cholecalciferol, etidronate, risedronate, risedronate calcium carbonate, pamidronate, and tiludronate;
one or more cyclooxygenase-2 (COX-2) inhibitors, preferably selected from the group consisting of valdecoxib, rofecoxib, and celecoxib;
one or more proton pump inhibitors, preferably selected from the group consisting of omeprazole and lansoprazole;
one or more anticonvulsants, preferably selected from the group consisting of phenytoin and valproic acid;
one or more histamine H2 receptor antagonist, preferably selected from the group consisting of nizatidine, ranitidine, famotidine, and cimetidine;
one or more diuretics, preferably selected from the group consisting of pamabrom, mannitol, a carbonic anhydrase inhibitor, a loop diuretic, preferably bumetanide, ethacrynic acid, or torsemide, furosemide, a potassium-sparing diuretics, preferably triamterene, spironolactone, or amiloride, or a thiazide diuretics, preferably indapamide, chlorthalidone, metolazone, methyclothiazide, hydrochlorothiazide, chlorothiazide, bendroflumethiazide, polythiazide, and hydroflumethiazide;
one or more narcotics or opioids, preferably selected from the group consisting of cocaine and heroin;
one or more elements or elemental metals, preferably selected from the group consisting of lithium, gold, copper, and mercury;
one or more direct-acting smooth muscle relaxant, preferably hydralazine;
one or more spasmolytic, preferably selected from the group consisting of carisoprodol, cyclobenzaprine, metaxalone, methocarbamol, diazepam, clonidine, tizanidine, baclofen, dantrolene, an imidazoline compound, a benzodiazepine, and a hydantoin derivative; and
one or more heavy metal toxicity drug, immunosuppressant, or chelating drug, preferably (D-) penicillamine.

83. The method of one of claims 73-82, wherein the Klotho protein sequence comprises, relative to SEQ ID NO: 1, one or more of F45, V45, C370, S370, F352, other than V352, H193, and other than R193.

84. The method of one of claims 73-83, wherein the Klotho protein sequence has at least 88%, 90%, 92%, 95%, 98%, 99%, or 100% amino acid sequence identity to one of SEQ ID NO: 4, SEQ ID NO: 9, and SEQ ID NO: 109.

85. The method of one of claims 73-84, wherein one or more of:
the at least a portion of the immunoglobulin Fc domain sequence has at least 88%, 89%, 90%, 91%, 92%, 93%, 94%, 95%, 96%, 97%, 98%, 99%, or 100% amino acid sequence identity to at least a portion of SEQ ID NO: 74; and
the at least a portion of the protease recognition sequence comprises at least a portion of a Tobacco Etch Virus (TEV) protease recognition sequence, preferably having at least 88%, 89%, 90%, 91%, 92%, 93%, 94%, 95%, 96%, 97%, 98%, 99%, or 100% amino acid sequence identity to at least a portion of SEQ ID NO: 106.

86. The method of one of claims 73-85, wherein the recombinant protein further comprises a linker, preferably disposed between the Klotho protein sequence and the one or more synthetic protein sequences, more preferably the linker having at least 88%, 89%, 90%, 91%, 92%, 93%, 94%, 95%, 96%, 97%, 98%, 99%, or 100% amino acid sequence identity to at least a portion of SEQ ID NO: 73.

87. The method of one of claims 73-86, wherein one or more of:
at least some of the recombinant protein is in a coated, encapsulated, controlled-release, extended-release, delayed-release, or sustained-release formulation; and
the composition further comprises one or more components selected from the group consisting of aggregation inhibitors, buffers, tonicity modifiers, and additional excipients.

88. A method of treating and/or preventing kidney injury in a mammalian subject, the method comprising:
administering to the subject, prophylactically, prior to a medical procedure or administration of a nephrotoxin and/or following a medical procedure or administration of a nephrotoxin, a pharmaceutical composition comprising:
a pharmaceutically-acceptable carrier or excipient; and
an effective amount of a recombinant protein comprising:
a Klotho protein sequence having at least 85% amino acid sequence identity to one of SEQ ID NO: 4, SEQ ID NO: 9, and SEQ ID NO: 109; and optionally
one or more synthetic protein sequences selected from the group consisting of:
at least a portion of an immunoglobulin Fc domain; and
at least a portion of a protease recognition sequence.

89. A method of treating and/or preventing a condition, disease, or disorder, preferably a condition, disease, or disorder associated with aging, in a mammalian subject, the method comprising:
administering to the subject a pharmaceutical composition comprising:
a pharmaceutically-acceptable carrier or excipient; and
an effective amount of a recombinant protein comprising:
a Klotho protein sequence having at least 85% amino acid sequence identity to one of SEQ ID NO: 4, SEQ ID NO: 9, and SEQ ID NO: 109; and optionally
one or more synthetic protein sequences selected from the group consisting of:
at least a portion of an immunoglobulin Fc domain; and
at least a portion of a protease recognition sequence.

90. The method of claim 89, wherein the condition, disease, or disorder is selected from the group consisting of frailty; bone density loss; bone mineral density loss; weight loss; muscular atrophy; muscular degeneration; decline in muscle mass; decline in muscle strength; decline in hand strength; decline in leg strength; decline in physical fitness; decline in movement; decline in freedom of movement; decline in quality of life assessment; decline in ejection fraction; decline in exercise capacity; decline in learning; decline in learning capacity; decline in memory; decline in intellectual quotient; cognitive deterioration; forgetfulness; decline in cognitive capacity; decline in cognitive function; decline in synaptic plasticity; decline in synaptic function; cellular senescence; chronic kidney disease (CKD); chronic kidney disease—mineral and bone disorder (CKD-MBD); polycystic kidney disease (PKD); autosomal dominant polycystic kidney disease (ADPKD); acute kidney injury (AKI); acute tubular necrosis (ATN); acute allergic interstitial nephritis (AAIN); glomerulonephritis; kidney disease; renal failure; Alport Syndrome; nonoliguric renal failure; alcoholism; hyperphosphatemia; muscular dystrophy (MS); type 1 diabetes; type 2 diabetes; cardiovascular disease (CVD); cardiovascular calcification; cerebrovascular insufficiency; vascular calcification; coronary artery disease; heart failure; left ventricular hypertrophy; uremic cardiomyopathy; abnormalities in blood pressure; salt-sensitive hypertension; tissue calcification; calcific atherosclerotic plaque burden; calcinosis; familial tumoral calcinosis; cancer; one or more tumors; myelin-related diseases; demyelinating diseases; neurodegenerative disease; neurovascular diseases; progressive supranuclear palsy (PSP); Pompe disease; Niemann-Pick disease; microgliosis; Farber disease (FD); bone mass diseases; osteoporosis; osteopenia; osteopenia (particularly loss of BMD of cortical bone); pulmonary emphysema; pulmonary fibrosis; cystic fibrosis, idiopathic (i.e., cause unknown) pulmonary fibrosis, radiation-induced lung injury, cirrhosis, biliary atresia, atrial fibrosis, endomyocardial fibrosis, (old) myocardial infarction, glial scar, arterial stiffness, arthrofibrosis, Crohn's disease, Dupuytren's contracture, keloid, mediastinal fibrosis, myelofibrosis, Peyronie's disease, nephrogenic systemic fibrosis, progressive massive fibrosis, retroperitoneal fibrosis, scleroderma/systemic sclerosis, adhesive capsulitis, skin atrophy; thymic atrophy; accumulation of renal interstitial matrix; glomerulosclerosis; anemia; albuminuria; proteinuria; infertility; Alzheimer's disease; Parkinson's Disease; dementia; vascular dementia; amyotrophic lateral sclerosis (ALS); motor neuron disease (MND); atrial fibrillation; chronic obstructive pulmonary disease (COPD); fibromyalgia; adult onset diabetes; arthritis; rheumatoid arthritis; osteoarthritis; glaucoma; cataracts; macular degeneration; multiple sclerosis (MS); lupus; ulcerative colitis; cachexia; obesity; vitamin D-related conditions; bone diseases; bone diseases through bone remodeling; stem cell depletion; sea sickness; space adaptation syndrome (SAS); nausea; vertigo; non-alcoholic steatohepatitis (NASH), cirrhosis of the liver and alcoholic steatohepatitis.

91. A method of improving health and/or maintaining youthfulness in a mammalian subject, the method comprising:
administering to the subject a pharmaceutical composition comprising:
a pharmaceutically-acceptable carrier or excipient; and
an effective amount of a recombinant protein comprising
a Klotho protein sequence having at least 85% amino acid sequence identity to one of SEQ ID NO: 4, SEQ ID NO: 9, and SEQ ID NO: 109; and optionally
one or more synthetic protein sequences selected from the group consisting of:
at least a portion of an immunoglobulin Fc domain; and
at least a portion of a protease recognition sequence.

92. The method of any one of claims 73-91, further comprising pre-administering, co-administering, and/or post-administering one or more additional active ingredients.

93. The method of claim 92, wherein the one or more additional active ingredients are selected from the group consisting of a drug, an antibody, a hormone, radiocontrast, a medicament, or a composition.

94. A pharmaceutical composition for use in treating and/or preventing kidney injury in a mammalian subject, the composition comprising:
a pharmaceutically-acceptable carrier or excipient; and
an effective amount of a recombinant protein comprising:
a Klotho protein sequence having at least 85% amino acid sequence identity to one of SEQ ID NO: 4, SEQ ID NO: 9, and SEQ ID NO: 109; and optionally
one or more synthetic protein sequences selected from the group consisting of:
at least a portion of an immunoglobulin Fc domain; and
at least a portion of a protease recognition sequence.

95. The pharmaceutical composition of claim 94, wherein the kidney injury is selected from the group consisting of:
(i) surgery- or other medical procedure-induced kidney damage, preferably kidney surgery-induced kidney damage, more preferably kidney transplant-induced kidney damage;
(ii) renal ischemia, preferably surgery- or other medical procedure-induced renal ischemia, more preferably:
kidney surgery-induced renal ischemia, preferably kidney transplant-induced renal ischemia; and/or
cardio-vascular surgery-induced renal ischemia, preferably heart bypass surgery-induced renal ischemia, more preferably coronary artery bypass (graft) surgery-induced renal ischemia, most preferably cardiopulmonary bypass surgery-induced renal ischemia; and
(iii) nephrotoxicity, preferably drug-induced nephrotoxicity, more preferably anti-microbial-induced nephrotoxicity or aminoglycoside-induced nephrotoxicity.

96. A pharmaceutical composition, comprising:
a pharmaceutically-acceptable carrier or excipient; and
an effective amount of a recombinant protein comprising:
a Klotho protein sequence having at least 85% amino acid sequence identity to one of SEQ ID NO: 4, SEQ ID NO: 9, and SEQ ID NO: 109; and optionally
one or more synthetic protein sequences selected from the group consisting of:
at least a portion of an immunoglobulin Fc domain; and
at least a portion of a protease recognition sequence.

97. A recombinant protein comprising:
a Klotho protein sequence having at least 85% amino acid sequence identity to one of SEQ ID NO: 4, SEQ ID NO: 9, and SEQ ID NO: 109; and
one or more synthetic protein sequences selected from the group consisting of:
at least a portion of an immunoglobulin Fc domain; and
at least a portion of a protease recognition sequence.

98. A nucleic acid construct, comprising a nucleic acid sequence encoding a recombinant protein, the recombinant protein comprising:
a Klotho protein sequence having at least 85% amino acid sequence identity to one of SEQ ID NO: 4, SEQ ID NO: 9, and SEQ ID NO: 109; and optionally
one or more synthetic protein sequences selected from the group consisting of:
at least a portion of an immunoglobulin Fc domain;
at least a portion of a protease recognition sequence; and
at least a portion of an affinity tag sequence, preferably comprising at least one streptavidin sequence, more preferably comprising two or more streptavidin sequences, preferably having a spacer disposed therebetween.

99. The nucleic acid construct of claim 98, further comprising a promoter, the nucleic acid sequence encoding the recombinant protein being under control of the promoter.

100. Any one of claims 73-99, wherein the recombinant protein comprises at least 86%, 87%, 88%, 89%, 90%, 91%, 92%, 93%, 94%, 95%, 96%, 97%, 98%, or 99%, or 100% amino acid sequence identity, to one of SEQ ID NO: 52, SEQ ID NO: 54, and SEQ ID NO: 66.

Example 10

In addition to the foregoing, one or more non-human, mammalian Klotho proteins or protein sequences (or portion(s) thereof) can be useful in implementing certain embodiments of the present disclosure. SEQ ID NOS: 121-124 present DNA sequences for encoding various non-human mammalian Klotho proteins. SEQ ID NOS: 111-120 present amino acid sequences for various non-human mammals. These Klotho protein sequences (or portion(s) thereof) can be expressed, purified, formulated into compositions, and/or administered to animals in a manner similar to that described above. Therapeutics administration of recombinant Klotho (fusion) proteins can be effective in treating the non-human mammal version of the medical and other conditions outlined herein. In particular, embodiments of the present disclosure can include veterinary treatment method, proteins, and compositions, as will be understood by those skilled in the art.

CONCLUSION

While the foregoing detailed description makes reference to specific exemplary embodiments, the present disclosure may be embodied in other specific forms without departing from its spirit or essential characteristics. Accordingly, the described embodiments are to be considered in all respects only as illustrative and not restrictive. For instance, various substitutions, alterations, and/or modifications of the inventive features described and/or illustrated herein, and additional applications of the principles described and/or illustrated herein, which would occur to one skilled in the relevant art and having possession of this disclosure, can be made to the described and/or illustrated embodiments without departing from the spirit and scope of the disclosure as defined by the appended claims. Such substitutions, alterations, and/or modifications are to be considered within the scope of this disclosure.

The scope of the invention is, therefore, indicated by the appended claims rather than by the foregoing description. The limitations recited in the claims are to be interpreted broadly based on the language employed in the claims and not limited to specific examples described in the foregoing detailed description, which examples are to be construed as non-exclusive and non-exhaustive. All changes which come within the meaning and range of equivalency of the claims are to be embraced within their scope.

It will also be appreciated that various features of certain embodiments can be compatible with, combined with, included in, and/or incorporated into other embodiments of the present disclosure. For instance, systems, methods, and/or products according to certain embodiments of the present disclosure may include, incorporate, or otherwise comprise features described in other embodiments disclosed and/or described herein. Thus, disclosure of certain features relative to a specific embodiment of the present disclosure should not be construed as limiting application or inclusion of said features to the specific embodiment.

In addition, unless a feature is described as being requiring in a particular embodiment, features described in the various embodiments can be optional and may not be included in other embodiments of the present disclosure. Moreover, unless a feature is described as requiring another feature in combination therewith, any feature herein may be combined with any other feature of a same or different embodiment disclosed herein. It will be appreciated that while features may be optional in certain embodiments, when features are included in such embodiments, they can be required to have a specific configuration as described in the present disclosure.

Likewise, any steps recited in any method or process described herein and/or recited in the claims can be executed in any suitable order and are not necessarily limited to the order described and/or recited, unless otherwise stated (explicitly or implicitly). Such steps can, however, also be required to be performed in a specific order or any suitable order in certain embodiments of the present disclosure.

Furthermore, various well-known aspects of illustrative systems, methods, products, and the like are not described herein in particular detail in order to avoid obscuring aspects of the example embodiments. Such aspects are, however, also contemplated herein.

SEQUENCE LISTING

The Sequence Listing part of the disclosure is incorporated herein by reference.

SEQUENCE LISTING (124 sequences)

SEQ ID NO: 1 - protein, 1012 aa, Homo sapiens
MPASAPPRRPRPPPPSLSLLLVLLGLGGRRLRAEPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSLLAFIAFLFFASIISLSLIFYYSKKGRRSYK

SEQ ID NO: 2 - protein, 981 aa, Homo sapiens
MPASAPPRRPRPPPPSLSLLLVLLGLGGRRLRAEPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKS

SEQ ID NO: 3 - protein, 953 aa, Homo sapiens
RRLRAEPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKS

SEQ ID NO: 4 - protein, 948 aa, Homo sapiens
EPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKS

SEQ ID NO: 5 - protein, 946 aa, Homo sapiens
GDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKS

SEQ ID NO: 6 - protein, 851 aa, Homo sapiens
NVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKS

SEQ ID NO: 7 - protein, 549 aa, Homo sapiens
MPASAPPRRPRPPPPSLSLLLVLLGLGGRRLRAEPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLW

SEQ ID NO: 8 - protein, 521 aa, Homo sapiens
RRLRAEPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLW

SEQ ID NO: 9 - protein, 516 aa, Homo sapiens
EPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLW

SEQ ID NO: 10 - protein, 514 aa, Homo sapiens
GDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLW

SEQ ID NO: 11 - protein, 419 aa, Homo sapiens
NVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLW

SEQ ID NO: 12 - protein, 981 aa, Homo sapiens
MPASAPPRRPRPPPPSLSLLLVLLGLGGRRLRAEPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKS

SEQ ID NO: 13 - protein, 953 aa, Homo sapiens
RRLRAEPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKS

SEQ ID NO: 14 - protein, 948 aa, Homo sapiens
EPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKS

SEQ ID NO: 15 - protein, 946 aa, Homo sapiens
GDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKS

SEQ ID NO: 16 - protein, 851 aa, Homo sapiens
NVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKS

SEQ ID NO: 17 - protein, 549 aa, Homo sapiens
MPASAPPRRPRPPPPSLSLLLVLLGLGGRRLRAEPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLW

SEQ ID NO: 18 - protein, 521 aa, Homo sapiens
RRLRAEPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLW

SEQ ID NO: 19 - protein, 516 aa, Homo sapiens
EPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLW

SEQ ID NO: 20 - protein, 514 aa, Homo sapiens
GDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLW

SEQ ID NO: 21 - protein, 419 aa, Homo sapiens
NVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLW

SEQ ID NO: 22 - protein, 1012 aa, Homo sapiens [sequence omitted]

SEQ ID NO: 23 - protein, 981 aa, Homo sapiens
MPASAPPRRPRPPPPSLSLLLVLLGLGGRRLRAEPGDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKS

SEQ ID NO: 24 - protein, 953 aa, Homo sapiens
RRLRAEPGDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKS

SEQ ID NO: 25 - protein, 948 aa, Homo sapiens
EPGDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKS

SEQ ID NO: 26 - protein, 946 aa, Homo sapiens
GDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKS

SEQ ID NO: 27 - protein, 549 aa, Homo sapiens
MPASAPPRRPRPPPPSLSLLLVLLGLGGRRLRAEPGDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLW

SEQ ID NO: 28 - protein, 521 aa, Homo sapiens
RRLRAEPGDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLW

SEQ ID NO: 29 - protein, 516 aa, Homo sapiens
EPGDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLW

SEQ ID NO: 30 - protein, 514 aa, Homo sapiens
GDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLW

SEQ ID NO: 31 - protein, 981 aa, Homo sapiens
MPASAPPRRPRPPPPSLSLLLVLLGLGGRRLRAEPGDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKS

SEQ ID NO: 32 - protein, 953 aa, Homo sapiens
RRLRAEPGDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKS

SEQ ID NO: 33 - protein, 948 aa, Homo sapiens
EPGDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKS

SEQ ID NO: 34 - protein, 946 aa, Homo sapiens
GDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKS

SEQ ID NO: 35 - protein, 549 aa, Homo sapiens
MPASAPPRRPRPPPPSLSLLLVLLGLGGRRLRAEPGDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLW

SEQ ID NO: 36 - protein, 521 aa, Homo sapiens
RRLRAEPGDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLW

SEQ ID NO: 37 - protein, 516 aa, Homo sapiens
EPGDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLW

SEQ ID NO: 38 - protein, 514 aa, Homo sapiens
GDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLW

SEQ ID NO: 39 - protein, 1218 aa, Artificial Sequence
  Protein_Native_SS_34_981V_GS_IgG1_noCH1_Fc_Fusion
MPASAPPRRPRPPPPSLSLLLVLLGLGGRRLRAEPGDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 40 - protein, 1185 aa, Artificial Sequence
  Protein_34_981V_GS_IgG1_noCH1_Fc_Fusion
EPGDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41 - protein, 786 aa, Artificial Sequence
  Protein_Native_SS_34_549V_GS_IgG1_noCH1_Fc_Fusion
MPASAPPRRPRPPPPSLSLLLVLLGLGGRRLRAEPGDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVSQLTKPISSLTKPYHGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42 - protein, 753 aa, Artificial Sequence
  Protein_34_549V_GS_IgG1_noCH1_Fc_Fusion
EPGDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVSQLTKPISSLTKPYHGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43 - protein, 1218 aa, Artificial Sequence
  Protein_Native_SS_34_981V_C370S_GS_IgG1_noCH1_Fc_Fusion
MPASAPPRRPRPPPPSLSLLLVLLGLGGRRLRAEPGDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 44 - protein, 1185 aa, Artificial Sequence
  Protein_34_981V_C370S_GS_IgG1_noCH1_Fc_Fusion
EPGDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 45 - protein, 786 aa, Artificial Sequence
  Protein_Native_SS_34_549V_C370S_GS_IgG1_noCH1_Fc_Fusion
MPASAPPRRPRPPPPSLSLLLVLLGLGGRRLRAEPGDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVSQLTKPISSLTKPYHGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 46 - protein, 753 aa, Artificial Sequence
  Protein_34_549V_C370S_GS_IgG1_noCH1_Fc_Fusion
EPGDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVSQLTKPISSLTKPYHGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 47 - protein, 1183 aa, Artificial Sequence
  Protein_36_981V_GS_IgG1_noCH1_Fc_Fusion
GDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 48 - protein, 1183 aa, Artificial Sequence
  Protein_36_981V_C370S_GS_IgG1_noCH1_Fc_Fusion
GDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 49 - protein, 751 aa, Artificial Sequence
  Protein_36_549V_GS_IgG1_noCH1_Fc_Fusion
GDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVSQLTKPISSLTKPYHGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 50 - protein, 751 aa, Artificial Sequence
  Protein_36_549V_C370S_GS_IgG1_noCH1_Fc_Fusion
GDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVSQLTKPISSLTKPYHGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 51 - protein, 1218 aa, Artificial Sequence
  Protein_Native_SS_34_981F_GS_IgG1_noCH1_Fc_Fusion
MPASAPPRRPRPPPPSLSLLLVLLGLGGRRLRAEPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 52 - protein, 1185 aa, Artificial Sequence
  Protein_34_981F_GS_IgG1_noCH1_Fc_Fusion
EPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 53 - protein, 786 aa, Artificial Sequence
  Protein_Native_SS_34_549F_GS_IgG1_noCH1_Fc_Fusion
MPASAPPRRPRPPPPSLSLLLVLLGLGGRRLRAEPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVSQLTKPISSLTKPYHGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 54 - protein, 753 aa, Artificial Sequence
  Protein_34_549F_GS_IgG1_noCH1_Fc_Fusion
EPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVSQLTKPISSLTKPYHGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 55 - protein, 1218 aa, Artificial Sequence
  Protein_Native_SS_34_981F_C370S_GS_IgG1_noCH1_Fc_Fusion
MPASAPPRRPRPPPPSLSLLLVLLGLGGRRLRAEPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 56 - protein, 1185 aa, Artificial Sequence
  Protein_34_981F_C370S_GS_IgG1_noCH1_Fc_Fusion
EPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 57 - protein, 786 aa, Artificial Sequence
  Protein_Native_SS_34_549F_C370S_GS_IgG1_noCH1_Fc_Fusion
MPASAPPRRPRPPPPSLSLLLVLLGLGGRRLRAEPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVSQLTKPISSLTKPYHGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 58 - protein, 753 aa, Artificial Sequence
  Protein_34_549F_C370S_GS_IgG1_noCH1_Fc_Fusion
EPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVSQLTKPISSLTKPYHGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 59 - protein, 1183 aa, Artificial Sequence
  Protein_36_981F_GS_IgG1_noCH1_Fc_Fusion
GDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 60 - protein, 1183 aa, Artificial Sequence
  Protein_36_981F_C370S_GS_IgG1_noCH1_Fc_Fusion
GDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61 - protein, 751 aa, Artificial Sequence
  Protein_36_549F_GS_IgG1_noCH1_Fc_Fusion
GDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVSQLTKPISSLTKPYHGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 62 - protein, 751 aa, Artificial Sequence
  Protein_36_549F_C370S_GS_IgG1_noCH1_Fc_Fusion
GDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVSQLTKPISSLTKPYHGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 63 - protein, 988 aa, Artificial Sequence
  Protein_34_981V_TEV_TwinStrep
EPGDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSGGENLYFQSSAWSHPQFEKGGGSGGGSGGSSAWSHPQFEK

SEQ ID NO: 64 - protein, 956 aa, Artificial Sequence
  Protein_34_981V_minus_TEV_TwinStrep
EPGDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSGGENLYFQ

SEQ ID NO: 65 - protein, 988 aa, Artificial Sequence
  Protein_34_981F_TEV_TwinStrep
EPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSGGENLYFQSSAWSHPQFEKGGGSGGGSGGSSAWSHPQFEK

SEQ ID NO: 66 - protein, 956 aa, Artificial Sequence
  Protein_34_981F_minus_TEV_TwinStrep
EPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSGGENLYFQ

SEQ ID NO: 67 - protein, 988 aa, Artificial Sequence
  Protein_34_981V_C370S_TEV_TwinStrep
EPGDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSGGENLYFQSSAWSHPQFEKGGGSGGGSGGSSAWSHPQFEK

SEQ ID NO: 68 - protein, 956 aa, Artificial Sequence
  Protein_34_981V_C370S_minus_TEV_TwinStrep
EPGDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSGGENLYFQ

SEQ ID NO: 69 - protein, 988 aa, Artificial Sequence
  Protein_34_981F_C370S_TEV_TwinStrep
EPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSGGENLYFQSSAWSHPQFEKGGGSGGGSGGSSAWSHPQFEK

SEQ ID NO: 70 - protein, 956 aa, Artificial Sequence
  Protein_34_981F_C370S_minus_TEV_TwinStrep
EPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSGGENLYFQ

SEQ ID NO: 71 - protein, 33 aa, Homo sapiens
MPASAPPRRPRPPPPSLSLLLVLLGLGGRRLRA

SEQ ID NO: 72 - protein, 19 aa, Artificial Sequence
  Protein_Synthetic_Signal_Peptide
MARLTVLALLAGLLASSRA

SEQ ID NO: 73 - protein, 10 aa, Artificial Sequence
  Protein_GS_linker
GGGGSGGGGS

SEQ ID NO: 74 - protein, 227 aa, Artificial Sequence
  Protein_ IgG1_noCH1_Fc_Fusion
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 75 - protein, 40 aa, Artificial Sequence
  Protein_TwinStrep
GGENLYFQSSAWSHPQFEKGGGSGGGSGGSSAWSHPQFEK

SEQ ID NO: 76 - DNA, 3036 bp, Homo sapiens
atgcccgccagcgccccgccgcgccgcccgcggccgccgccgccgtcgctgtcgctgctgctggtgctgctgggcctgggcggccgccgcctgcgtgcggagccgggcgacggcgcgcagacctgggcccgtgtctcgcggcctcctgcccccgaggccgcgggcctcttccagggcaccttccccgacggcttcctctgggccgtgggcagcgccgcctaccagaccgagggcggctggcagcagcacggcaagggtgcgtccatctgggacacgttcacccaccaccccctggcacccccgggagactcccggaacgccagtctgccgttgggcgccccgtcgccgctgcagcccgccaccggggacgtagccagcgacagctacaacaacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggctcatgccaaagtctggcatctctacaatacttctttccgtcccactcagggaggtcaggtgtccattgccctaagctctcactggatcaatcctcgaagaatgaccgaccacagcatcaaagaatgtcaaaaatctctggactttgtactaggttggtttgccaaacccgtatttattgatggtgactatcccgagagcatgaagaataacctttcatctattctgcctgattttactgaatctgagaaaaagttcatcaaaggaactgctgacttttttgctctttgctttggacccaccttgagttttcaacttttggaccctcacatgaagttccgccaattggaatctcccaacctgaggcaactgctttcctggattgaccttgaatttaaccatcctcaaatatttattgtggaaaatggctggtttgtctcagggaccaccaagagagatgatgccaaatatatgtattacctcaaaaagttcatcatggaaaccttaaaagccatcaagctggatggggtggatgtcatcgggtataccgcatggtccctcatggatggtttcgagtggcacagaggttacagcatcaggcgtggactcttctatgttgactttctaagccaggacaagatgttgttgccaaagtcttcagccttgttctaccaaaagctgatagagaaaaatggcttccctcctttacctgaaaatcagcccctagaagggacatttccctgtgactttgcttggggagttgttgacaactacattcaagtagataccactctgtctcagtttaccgacctgaatgtttacctgtgggatgtccaccacagtaaaaggcttattaaagtggatggggttgtgaccaagaagaggaaatcctactgtgttgactttgctgccatccagccccagatcgctttactccaggaaatgcacgttacacattttcgcttctccctggactgggccctgattctccctctgggtaaccagtcccaggtgaaccacaccatcctgcagtactatcgctgcatggccagcgagcttgtccgtgtcaacatcaccccagtggtggccctgtggcagcctatggccccgaaccaaggactgccgcgcctcctggccaggcagggcgcctgggagaacccctacactgccctggcctttgcagagtatgcccgactgtgctttcaagagctcggccatcacgtcaagctttggataacgatgaatgagccgtatacaaggaatatgacatacagtgctggccacaaccttctgaaggcccatgccctggcttggcatgtgtacaatgaaaagtttaggcatgctcagaatgggaaaatatccatagccttgcaggctgattggatagaacctgcctgccctttctcccaaaaggacaaagaggtggccgagagagttttggaatttgacattggctggctggctgagcccattttcggctctggagattatccatgggtgatgagggactggctgaaccaaagaaacaattttcttcttccttatttcactgaagatgaaaaaaagctaatccagggtacctttgactttttggctttaagccattataccaccatccttgtagactcagaaaaagaagatccaataaaatacaatgattacctagaagtgcaagaaatgaccgacatcacgtggctcaactcccccagtcaggtggcggtagtgccctgggggttgcgcaaagtgctgaactggctgaagttcaagtacggagacctccccatgtacataatatccaacggaatcgatgacgggctgcatgctgaggacgaccagctgagggtgtattatatgcagaattacataaacgaagctctcaaagcccacatactggatggtatcaatctttgcggatactttgcttattcgtttaacgaccgcacagctccgaggtttggcctctatcgttatgctgcagatcagtttgagcccaaggcatccatgaaacattacaggaaaattattgacagcaatggtttcccgggcccagaaactctggaaagattttgtccagaagaattcaccgtgtgtactgagtgcagtttttttcacacccgaaagtctttactggctttcatagcttttctattttttgcttctattatttctctctcccttatattttactactcgaagaaaggcagaagaagttacaaa

SEQ ID NO: 77 - DNA, 2943 bp, Homo sapiens
atgcccgccagcgccccgccgcgccgcccgcggccgccgccgccgtcgctgtcgctgctgctggtgctgctgggcctgggcggccgccgcctgcgtgcggagccgggcgacggcgcgcagacctgggcccgtgtctcgcggcctcctgcccccgaggccgcgggcctcttccagggcaccttccccgacggcttcctctgggccgtgggcagcgccgcctaccagaccgagggcggctggcagcagcacggcaagggtgcgtccatctgggacacgttcacccaccaccccctggcacccccgggagactcccggaacgccagtctgccgttgggcgccccgtcgccgctgcagcccgccaccggggacgtagccagcgacagctacaacaacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggctcatgccaaagtctggcatctctacaatacttctttccgtcccactcagggaggtcaggtgtccattgccctaagctctcactggatcaatcctcgaagaatgaccgaccacagcatcaaagaatgtcaaaaatctctggactttgtactaggttggtttgccaaacccgtatttattgatggtgactatcccgagagcatgaagaataacctttcatctattctgcctgattttactgaatctgagaaaaagttcatcaaaggaactgctgacttttttgctctttgctttggacccaccttgagttttcaacttttggaccctcacatgaagttccgccaattggaatctcccaacctgaggcaactgctttcctggattgaccttgaatttaaccatcctcaaatatttattgtggaaaatggctggtttgtctcagggaccaccaagagagatgatgccaaatatatgtattacctcaaaaagttcatcatggaaaccttaaaagccatcaagctggatggggtggatgtcatcgggtataccgcatggtccctcatggatggtttcgagtggcacagaggttacagcatcaggcgtggactcttctatgttgactttctaagccaggacaagatgttgttgccaaagtcttcagccttgttctaccaaaagctgatagagaaaaatggcttccctcctttacctgaaaatcagcccctagaagggacatttccctgtgactttgcttggggagttgttgacaactacattcaagtagataccactctgtctcagtttaccgacctgaatgtttacctgtgggatgtccaccacagtaaaaggcttattaaagtggatggggttgtgaccaagaagaggaaatcctactgtgttgactttgctgccatccagccccagatcgctttactccaggaaatgcacgttacacattttcgcttctccctggactgggccctgattctccctctgggtaaccagtcccaggtgaaccacaccatcctgcagtactatcgctgcatggccagcgagcttgtccgtgtcaacatcaccccagtggtggccctgtggcagcctatggccccgaaccaaggactgccgcgcctcctggccaggcagggcgcctgggagaacccctacactgccctggcctttgcagagtatgcccgactgtgctttcaagagctcggccatcacgtcaagctttggataacgatgaatgagccgtatacaaggaatatgacatacagtgctggccacaaccttctgaaggcccatgccctggcttggcatgtgtacaatgaaaagtttaggcatgctcagaatgggaaaatatccatagccttgcaggctgattggatagaacctgcctgccctttctcccaaaaggacaaagaggtggccgagagagttttggaatttgacattggctggctggctgagcccattttcggctctggagattatccatgggtgatgagggactggctgaaccaaagaaacaattttcttcttccttatttcactgaagatgaaaaaaagctaatccagggtacctttgactttttggctttaagccattataccaccatccttgtagactcagaaaaagaagatccaataaaatacaatgattacctagaagtgcaagaaatgaccgacatcacgtggctcaactcccccagtcaggtggcggtagtgccctgggggttgcgcaaagtgctgaactggctgaagttcaagtacggagacctccccatgtacataatatccaacggaatcgatgacgggctgcatgctgaggacgaccagctgagggtgtattatatgcagaattacataaacgaagctctcaaagcccacatactggatggtatcaatctttgcggatactttgcttattcgtttaacgaccgcacagctccgaggtttggcctctatcgttatgctgcagatcagtttgagcccaaggcatccatgaaacattacaggaaaattattgacagcaatggtttcccgggcccagaaactctggaaagattttgtccagaagaattcaccgtgtgtactgagtgcagtttttttcacacccgaaagtct

SEQ ID NO: 78 - DNA, 2859 bp, Homo sapiens
cgccgcctgcgtgcggagccgggcgacggcgcgcagacctgggcccgtgtctcgcggcctcctgcccccgaggccgcgggcctcttccagggcaccttccccgacggcttcctctgggccgtgggcagcgccgcctaccagaccgagggcggctggcagcagcacggcaagggtgcgtccatctgggacacgttcacccaccaccccctggcacccccgggagactcccggaacgccagtctgccgttgggcgccccgtcgccgctgcagcccgccaccggggacgtagccagcgacagctacaacaacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggctcatgccaaagtctggcatctctacaatacttctttccgtcccactcagggaggtcaggtgtccattgccctaagctctcactggatcaatcctcgaagaatgaccgaccacagcatcaaagaatgtcaaaaatctctggactttgtactaggttggtttgccaaacccgtatttattgatggtgactatcccgagagcatgaagaataacctttcatctattctgcctgattttactgaatctgagaaaaagttcatcaaaggaactgctgacttttttgctctttgctttggacccaccttgagttttcaacttttggaccctcacatgaagttccgccaattggaatctcccaacctgaggcaactgctttcctggattgaccttgaatttaaccatcctcaaatatttattgtggaaaatggctggtttgtctcagggaccaccaagagagatgatgccaaatatatgtattacctcaaaaagttcatcatggaaaccttaaaagccatcaagctggatggggtggatgtcatcgggtataccgcatggtccctcatggatggtttcgagtggcacagaggttacagcatcaggcgtggactcttctatgttgactttctaagccaggacaagatgttgttgccaaagtcttcagccttgttctaccaaaagctgatagagaaaaatggcttccctcctttacctgaaaatcagcccctagaagggacatttccctgtgactttgcttggggagttgttgacaactacattcaagtagataccactctgtctcagtttaccgacctgaatgtttacctgtgggatgtccaccacagtaaaaggcttattaaagtggatggggttgtgaccaagaagaggaaatcctactgtgttgactttgctgccatccagccccagatcgctttactccaggaaatgcacgttacacattttcgcttctccctggactgggccctgattctccctctgggtaaccagtcccaggtgaaccacaccatcctgcagtactatcgctgcatggccagcgagcttgtccgtgtcaacatcaccccagtggtggccctgtggcagcctatggccccgaaccaaggactgccgcgcctcctggccaggcagggcgcctgggagaacccctacactgccctggcctttgcagagtatgcccgactgtgctttcaagagctcggccatcacgtcaagctttggataacgatgaatgagccgtatacaaggaatatgacatacagtgctggccacaaccttctgaaggcccatgccctggcttggcatgtgtacaatgaaaagtttaggcatgctcagaatgggaaaatatccatagccttgcaggctgattggatagaacctgcctgccctttctcccaaaaggacaaagaggtggccgagagagttttggaatttgacattggctggctggctgagcccattttcggctctggagattatccatgggtgatgagggactggctgaaccaaagaaacaattttcttcttccttatttcactgaagatgaaaaaaagctaatccagggtacctttgactttttggctttaagccattataccaccatccttgtagactcagaaaaagaagatccaataaaatacaatgattacctagaagtgcaagaaatgaccgacatcacgtggctcaactcccccagtcaggtggcggtagtgccctgggggttgcgcaaagtgctgaactggctgaagttcaagtacggagacctccccatgtacataatatccaacggaatcgatgacgggctgcatgctgaggacgaccagctgagggtgtattatatgcagaattacataaacgaagctctcaaagcccacatactggatggtatcaatctttgcggatactttgcttattcgtttaacgaccgcacagctccgaggtttggcctctatcgttatgctgcagatcagtttgagcccaaggcatccatgaaacattacaggaaaattattgacagcaatggtttcccgggcccagaaactctggaaagattttgtccagaagaattcaccgtgtgtactgagtgcagtttttttcacacccgaaagtct

SEQ ID NO: 79 - DNA, 2844 bp, Homo sapiens
gagccgggcgacggcgcgcagacctgggcccgtgtctcgcggcctcctgcccccgaggccgcgggcctcttccagggcaccttccccgacggcttcctctgggccgtgggcagcgccgcctaccagaccgagggcggctggcagcagcacggcaagggtgcgtccatctgggacacgttcacccaccaccccctggcacccccgggagactcccggaacgccagtctgccgttgggcgccccgtcgccgctgcagcccgccaccggggacgtagccagcgacagctacaacaacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggctcatgccaaagtctggcatctctacaatacttctttccgtcccactcagggaggtcaggtgtccattgccctaagctctcactggatcaatcctcgaagaatgaccgaccacagcatcaaagaatgtcaaaaatctctggactttgtactaggttggtttgccaaacccgtatttattgatggtgactatcccgagagcatgaagaataacctttcatctattctgcctgattttactgaatctgagaaaaagttcatcaaaggaactgctgacttttttgctctttgctttggacccaccttgagttttcaacttttggaccctcacatgaagttccgccaattggaatctcccaacctgaggcaactgctttcctggattgaccttgaatttaaccatcctcaaatatttattgtggaaaatggctggtttgtctcagggaccaccaagagagatgatgccaaatatatgtattacctcaaaaagttcatcatggaaaccttaaaagccatcaagctggatggggtggatgtcatcgggtataccgcatggtccctcatggatggtttcgagtggcacagaggttacagcatcaggcgtggactcttctatgttgactttctaagccaggacaagatgttgttgccaaagtcttcagccttgttctaccaaaagctgatagagaaaaatggcttccctcctttacctgaaaatcagcccctagaagggacatttccctgtgactttgcttggggagttgttgacaactacattcaagtagataccactctgtctcagtttaccgacctgaatgtttacctgtgggatgtccaccacagtaaaaggcttattaaagtggatggggttgtgaccaagaagaggaaatcctactgtgttgactttgctgccatccagccccagatcgctttactccaggaaatgcacgttacacattttcgcttctccctggactgggccctgattctccctctgggtaaccagtcccaggtgaaccacaccatcctgcagtactatcgctgcatggccagcgagcttgtccgtgtcaacatcaccccagtggtggccctgtggcagcctatggccccgaaccaaggactgccgcgcctcctggccaggcagggcgcctgggagaacccctacactgccctggcctttgcagagtatgcccgactgtgctttcaagagctcggccatcacgtcaagctttggataacgatgaatgagccgtatacaaggaatatgacatacagtgctggccacaaccttctgaaggcccatgccctggcttggcatgtgtacaatgaaaagtttaggcatgctcagaatgggaaaatatccatagccttgcaggctgattggatagaacctgcctgccctttctcccaaaaggacaaagaggtggccgagagagttttggaatttgacattggctggctggctgagcccattttcggctctggagattatccatgggtgatgagggactggctgaaccaaagaaacaattttcttcttccttatttcactgaagatgaaaaaaagctaatccagggtacctttgactttttggctttaagccattataccaccatccttgtagactcagaaaaagaagatccaataaaatacaatgattacctagaagtgcaagaaatgaccgacatcacgtggctcaactcccccagtcaggtggcggtagtgccctgggggttgcgcaaagtgctgaactggctgaagttcaagtacggagacctccccatgtacataatatccaacggaatcgatgacgggctgcatgctgaggacgaccagctgagggtgtattatatgcagaattacataaacgaagctctcaaagcccacatactggatggtatcaatctttgcggatactttgcttattcgtttaacgaccgcacagctccgaggtttggcctctatcgttatgctgcagatcagtttgagcccaaggcatccatgaaacattacaggaaaattattgacagcaatggtttcccgggcccagaaactctggaaagattttgtccagaagaattcaccgtgtgtactgagtgcagtttttttcacacccgaaagtct

SEQ ID NO: 80 - DNA, 2838 bp, Homo sapiens
ggcgacggcgcgcagacctgggcccgtgtctcgcggcctcctgcccccgaggccgcgggcctcttccagggcaccttccccgacggcttcctctgggccgtgggcagcgccgcctaccagaccgagggcggctggcagcagcacggcaagggtgcgtccatctgggacacgttcacccaccaccccctggcacccccgggagactcccggaacgccagtctgccgttgggcgccccgtcgccgctgcagcccgccaccggggacgtagccagcgacagctacaacaacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggctcatgccaaagtctggcatctctacaatacttctttccgtcccactcagggaggtcaggtgtccattgccctaagctctcactggatcaatcctcgaagaatgaccgaccacagcatcaaagaatgtcaaaaatctctggactttgtactaggttggtttgccaaacccgtatttattgatggtgactatcccgagagcatgaagaataacctttcatctattctgcctgattttactgaatctgagaaaaagttcatcaaaggaactgctgacttttttgctctttgctttggacccaccttgagttttcaacttttggaccctcacatgaagttccgccaattggaatctcccaacctgaggcaactgctttcctggattgaccttgaatttaaccatcctcaaatatttattgtggaaaatggctggtttgtctcagggaccaccaagagagatgatgccaaatatatgtattacctcaaaaagttcatcatggaaaccttaaaagccatcaagctggatggggtggatgtcatcgggtataccgcatggtccctcatggatggtttcgagtggcacagaggttacagcatcaggcgtggactcttctatgttgactttctaagccaggacaagatgttgttgccaaagtcttcagccttgttctaccaaaagctgatagagaaaaatggcttccctcctttacctgaaaatcagcccctagaagggacatttccctgtgactttgcttggggagttgttgacaactacattcaagtagataccactctgtctcagtttaccgacctgaatgtttacctgtgggatgtccaccacagtaaaaggcttattaaagtggatggggttgtgaccaagaagaggaaatcctactgtgttgactttgctgccatccagccccagatcgctttactccaggaaatgcacgttacacattttcgcttctccctggactgggccctgattctccctctgggtaaccagtcccaggtgaaccacaccatcctgcagtactatcgctgcatggccagcgagcttgtccgtgtcaacatcaccccagtggtggccctgtggcagcctatggccccgaaccaaggactgccgcgcctcctggccaggcagggcgcctgggagaacccctacactgccctggcctttgcagagtatgcccgactgtgctttcaagagctcggccatcacgtcaagctttggataacgatgaatgagccgtatacaaggaatatgacatacagtgctggccacaaccttctgaaggcccatgccctggcttggcatgtgtacaatgaaaagtttaggcatgctcagaatgggaaaatatccatagccttgcaggctgattggatagaacctgcctgccctttctcccaaaaggacaaagaggtggccgagagagttttggaatttgacattggctggctggctgagcccattttcggctctggagattatccatgggtgatgagggactggctgaaccaaagaaacaattttcttcttccttatttcactgaagatgaaaaaaagctaatccagggtacctttgactttttggctttaagccattataccaccatccttgtagactcagaaaaagaagatccaataaaatacaatgattacctagaagtgcaagaaatgaccgacatcacgtggctcaactcccccagtcaggtggcggtagtgccctgggggttgcgcaaagtgctgaactggctgaagttcaagtacggagacctccccatgtacataatatccaacggaatcgatgacgggctgcatgctgaggacgaccagctgagggtgtattatatgcagaattacataaacgaagctctcaaagcccacatactggatggtatcaatctttgcggatactttgcttattcgtttaacgaccgcacagctccgaggtttggcctctatcgttatgctgcagatcagtttgagcccaaggcatccatgaaacattacaggaaaattattgacagcaatggtttcccgggcccagaaactctggaaagattttgtccagaagaattcaccgtgtgtactgagtgcagtttttttcacacccgaaagtct

SEQ ID NO: 81 - DNA, 2553 bp, Homo sapiens
aacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggctcatgccaaagtctggcatctctacaatacttctttccgtcccactcagggaggtcaggtgtccattgccctaagctctcactggatcaatcctcgaagaatgaccgaccacagcatcaaagaatgtcaaaaatctctggactttgtactaggttggtttgccaaacccgtatttattgatggtgactatcccgagagcatgaagaataacctttcatctattctgcctgattttactgaatctgagaaaaagttcatcaaaggaactgctgacttttttgctctttgctttggacccaccttgagttttcaacttttggaccctcacatgaagttccgccaattggaatctcccaacctgaggcaactgctttcctggattgaccttgaatttaaccatcctcaaatatttattgtggaaaatggctggtttgtctcagggaccaccaagagagatgatgccaaatatatgtattacctcaaaaagttcatcatggaaaccttaaaagccatcaagctggatggggtggatgtcatcgggtataccgcatggtccctcatggatggtttcgagtggcacagaggttacagcatcaggcgtggactcttctatgttgactttctaagccaggacaagatgttgttgccaaagtcttcagccttgttctaccaaaagctgatagagaaaaatggcttccctcctttacctgaaaatcagcccctagaagggacatttccctgtgactttgcttggggagttgttgacaactacattcaagtagataccactctgtctcagtttaccgacctgaatgtttacctgtgggatgtccaccacagtaaaaggcttattaaagtggatggggttgtgaccaagaagaggaaatcctactgtgttgactttgctgccatccagccccagatcgctttactccaggaaatgcacgttacacattttcgcttctccctggactgggccctgattctccctctgggtaaccagtcccaggtgaaccacaccatcctgcagtactatcgctgcatggccagcgagcttgtccgtgtcaacatcaccccagtggtggccctgtggcagcctatggccccgaaccaaggactgccgcgcctcctggccaggcagggcgcctgggagaacccctacactgccctggcctttgcagagtatgcccgactgtgctttcaagagctcggccatcacgtcaagctttggataacgatgaatgagccgtatacaaggaatatgacatacagtgctggccacaaccttctgaaggcccatgccctggcttggcatgtgtacaatgaaaagtttaggcatgctcagaatgggaaaatatccatagccttgcaggctgattggatagaacctgcctgccctttctcccaaaaggacaaagaggtggccgagagagttttggaatttgacattggctggctggctgagcccattttcggctctggagattatccatgggtgatgagggactggctgaaccaaagaaacaattttcttcttccttatttcactgaagatgaaaaaaagctaatccagggtacctttgactttttggctttaagccattataccaccatccttgtagactcagaaaaagaagatccaataaaatacaatgattacctagaagtgcaagaaatgaccgacatcacgtggctcaactcccccagtcaggtggcggtagtgccctgggggttgcgcaaagtgctgaactggctgaagttcaagtacggagacctccccatgtacataatatccaacggaatcgatgacgggctgcatgctgaggacgaccagctgagggtgtattatatgcagaattacataaacgaagctctcaaagcccacatactggatggtatcaatctttgcggatactttgcttattcgtttaacgaccgcacagctccgaggtttggcctctatcgttatgctgcagatcagtttgagcccaaggcatccatgaaacattacaggaaaattattgacagcaatggtttcccgggcccagaaactctggaaagattttgtccagaagaattcaccgtgtgtactgagtgcagtttttttcacacccgaaagtct

SEQ ID NO: 82 - DNA, 1648 bp, Homo sapiens
atgcccgccagcgccccgccgcgccgcccgcggccgccgccgccgtcgctgtcgctgctgctggtgctgctgggcctgggcggccgccgcctgcgtgcggagccgggcgacggcgcgcagacctgggcccgtgtctcgcggcctcctgcccccgaggccgcgggcctcttccagggcaccttccccgacggcttcctctgggccgtgggcagcgccgcctaccagaccgagggcggctggcagcagcacggcaagggtgcgtccatctgggacacgttcacccaccaccccctggcacccccgggagactcccggaacgccagtctgccgttgggcgccccgtcgccgctgcagcccgccaccggggacgtagccagcgacagctacaacaacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggctcatgccaaagtctggcatctctacaatacttctttccgtcccactcagggaggtcaggtgtccattgccctaagctctcactggatcaatcctcgaagaatgaccgaccacagcatcaaagaatgtcaaaaatctctggactttgtactaggttggtttgccaaacccgtatttattgatggtgactatcccgagagcatgaagaataacctttcatctattctgcctgattttactgaatctgagaaaaagttcatcaaaggaactgctgacttttttgctctttgctttggacccaccttgagttttcaacttttggaccctcacatgaagttccgccaattggaatctcccaacctgaggcaactgctttcctggattgaccttgaatttaaccatcctcaaatatttattgtggaaaatggctggtttgtctcagggaccaccaagagagatgatgccaaatatatgtattacctcaaaaagttcatcatggaaaccttaaaagccatcaagctggatggggtggatgtcatcgggtataccgcatggtccctcatggatggtttcgagtggcacagaggttacagcatcaggcgtggactcttctatgttgactttctaagccaggacaagatgttgttgccaaagtcttcagccttgttctaccaaaagctgatagagaaaaatggcttccctcctttacctgaaaatcagcccctagaagggacatttccctgtgactttgcttggggagttgttgacaactacattcaagtagataccactctgtctcagtttaccgacctgaatgtttacctgtggg

SEQ ID NO: 83 - DNA, 1564 bp, Homo sapiens
cgccgcctgcgtgcggagccgggcgacggcgcgcagacctgggcccgtgtctcgcggcctcctgcccccgaggccgcgggcctcttccagggcaccttccccgacggcttcctctgggccgtgggcagcgccgcctaccagaccgagggcggctggcagcagcacggcaagggtgcgtccatctgggacacgttcacccaccaccccctggcacccccgggagactcccggaacgccagtctgccgttgggcgccccgtcgccgctgcagcccgccaccggggacgtagccagcgacagctacaacaacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggctcatgccaaagtctggcatctctacaatacttctttccgtcccactcagggaggtcaggtgtccattgccctaagctctcactggatcaatcctcgaagaatgaccgaccacagcatcaaagaatgtcaaaaatctctggactttgtactaggttggtttgccaaacccgtatttattgatggtgactatcccgagagcatgaagaataacctttcatctattctgcctgattttactgaatctgagaaaaagttcatcaaaggaactgctgacttttttgctctttgctttggacccaccttgagttttcaacttttggaccctcacatgaagttccgccaattggaatctcccaacctgaggcaactgctttcctggattgaccttgaatttaaccatcctcaaatatttattgtggaaaatggctggtttgtctcagggaccaccaagagagatgatgccaaatatatgtattacctcaaaaagttcatcatggaaaccttaaaagccatcaagctggatggggtggatgtcatcgggtataccgcatggtccctcatggatggtttcgagtggcacagaggttacagcatcaggcgtggactcttctatgttgactttctaagccaggacaagatgttgttgccaaagtcttcagccttgttctaccaaaagctgatagagaaaaatggcttccctcctttacctgaaaatcagcccctagaagggacatttccctgtgactttgcttggggagttgttgacaactacattcaagtagataccactctgtctcagtttaccgacctgaatgtttacctgtggg

SEQ ID NO: 84 - DNA, 1549 bp, Homo sapiens
gagccgggcgacggcgcgcagacctgggcccgtgtctcgcggcctcctgcccccgaggccgcgggcctcttccagggcaccttccccgacggcttcctctgggccgtgggcagcgccgcctaccagaccgagggcggctggcagcagcacggcaagggtgcgtccatctgggacacgttcacccaccaccccctggcacccccgggagactcccggaacgccagtctgccgttgggcgccccgtcgccgctgcagcccgccaccggggacgtagccagcgacagctacaacaacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggctcatgccaaagtctggcatctctacaatacttctttccgtcccactcagggaggtcaggtgtccattgccctaagctctcactggatcaatcctcgaagaatgaccgaccacagcatcaaagaatgtcaaaaatctctggactttgtactaggttggtttgccaaacccgtatttattgatggtgactatcccgagagcatgaagaataacctttcatctattctgcctgattttactgaatctgagaaaaagttcatcaaaggaactgctgacttttttgctctttgctttggacccaccttgagttttcaacttttggaccctcacatgaagttccgccaattggaatctcccaacctgaggcaactgctttcctggattgaccttgaatttaaccatcctcaaatatttattgtggaaaatggctggtttgtctcagggaccaccaagagagatgatgccaaatatatgtattacctcaaaaagttcatcatggaaaccttaaaagccatcaagctggatggggtggatgtcatcgggtataccgcatggtccctcatggatggtttcgagtggcacagaggttacagcatcaggcgtggactcttctatgttgactttctaagccaggacaagatgttgttgccaaagtcttcagccttgttctaccaaaagctgatagagaaaaatggcttccctcctttacctgaaaatcagcccctagaagggacatttccctgtgactttgcttggggagttgttgacaactacattcaagtagataccactctgtctcagtttaccgacctgaatgtttacctgtggg

SEQ ID NO: 85 - DNA, 1543 bp, Homo sapiens
ggcgacggcgcgcagacctgggcccgtgtctcgcggcctcctgcccccgaggccgcgggcctcttccagggcaccttccccgacggcttcctctgggccgtgggcagcgccgcctaccagaccgagggcggctggcagcagcacggcaagggtgcgtccatctgggacacgttcacccaccaccccctggcacccccgggagactcccggaacgccagtctgccgttgggcgccccgtcgccgctgcagcccgccaccggggacgtagccagcgacagctacaacaacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggctcatgccaaagtctggcatctctacaatacttctttccgtcccactcagggaggtcaggtgtccattgccctaagctctcactggatcaatcctcgaagaatgaccgaccacagcatcaaagaatgtcaaaaatctctggactttgtactaggttggtttgccaaacccgtatttattgatggtgactatcccgagagcatgaagaataacctttcatctattctgcctgattttactgaatctgagaaaaagttcatcaaaggaactgctgacttttttgctctttgctttggacccaccttgagttttcaacttttggaccctcacatgaagttccgccaattggaatctcccaacctgaggcaactgctttcctggattgaccttgaatttaaccatcctcaaatatttattgtggaaaatggctggtttgtctcagggaccaccaagagagatgatgccaaatatatgtattacctcaaaaagttcatcatggaaaccttaaaagccatcaagctggatggggtggatgtcatcgggtataccgcatggtccctcatggatggtttcgagtggcacagaggttacagcatcaggcgtggactcttctatgttgactttctaagccaggacaagatgttgttgccaaagtcttcagccttgttctaccaaaagctgatagagaaaaatggcttccctcctttacctgaaaatcagcccctagaagggacatttccctgtgactttgcttggggagttgttgacaactacattcaagtagataccactctgtctcagtttaccgacctgaatgtttacctgtggg

SEQ ID NO: 86 - DNA, 1258 bp, Homo sapiens
aacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggctcatgccaaagtctggcatctctacaatacttctttccgtcccactcagggaggtcaggtgtccattgccctaagctctcactggatcaatcctcgaagaatgaccgaccacagcatcaaagaatgtcaaaaatctctggactttgtactaggttggtttgccaaacccgtatttattgatggtgactatcccgagagcatgaagaataacctttcatctattctgcctgattttactgaatctgagaaaaagttcatcaaaggaactgctgacttttttgctctttgctttggacccaccttgagttttcaacttttggaccctcacatgaagttccgccaattggaatctcccaacctgaggcaactgctttcctggattgaccttgaatttaaccatcctcaaatatttattgtggaaaatggctggtttgtctcagggaccaccaagagagatgatgccaaatatatgtattacctcaaaaagttcatcatggaaaccttaaaagccatcaagctggatggggtggatgtcatcgggtataccgcatggtccctcatggatggtttcgagtggcacagaggttacagcatcaggcgtggactcttctatgttgactttctaagccaggacaagatgttgttgccaaagtcttcagccttgttctaccaaaagctgatagagaaaaatggcttccctcctttacctgaaaatcagcccctagaagggacatttccctgtgactttgcttggggagttgttgacaactacattcaagtagataccactctgtctcagtttaccgacctgaatgtttacctgtggg

SEQ ID NO: 87 - DNA, 3654 bp, Artificial Sequence
  DNA_Native_SS_34_981_GS_IgG1_noCH1_Fc_Fusion
atgcctgcttccgccccgcctagaaggcctcggcctcctccccccagcctgtctctgctcttggtgctgctgggactgggtggacggcgccttcgcgcagagcctggcgacggcgcccagacctgggcccgggtgtcgaggccgccagcgcccgaggccgccggactgttccagggaaccttccctgatgggttcctctgggccgtgggctcagccgcataccagaccgaggggggctggcagcagcacggaaagggcgccagcatatgggacacgttcacccaccacccgctggctccgcccggggactccagaaacgcctccttgcccctcggtgctccttcgccactgcaacccgcaaccggcgacgtggccagcgattcatacaacaacgtgttccgggacaccgaggccctgagggaactgggagtgactcactaccgcttttcgatctcctgggcacgcgtgctcccgaacggatcggcgggagtgccgaatcgcgagggcctgcggtactaccgacggctgctggaaaggctcagagaactgggcgtgcagcctgtcgtgactctttaccactgggatctgccccaacggctgcaggatgcttacgggggatgggccaatagagccctggctgatcacttccgcgactacgccgaattgtgcttccggcacttcggtggccaagtcaagtactggattaccatcgacaacccatacgtcgtggcgtggcacggatacgcaaccggtcggctggcccctggtattcgcgggtccccgcggcttggatacctggtggcccacaacctgttgctcgcgcatgccaaagtctggcacctgtacaacacctcgttccggccgacccagggtggacaagtgtccatcgccctgtcgtcacactggatcaacccgcggagaatgaccgaccactccatcaaggaatgccagaagtccctcgatttcgtgttgggctggtttgccaagcctgtgtttattgacggagactaccccgagtccatgaagaacaacctgtcgtctatcctgcccgatttcactgaatccgagaaaaagtttatcaagggaaccgctgacttcttcgccctctgtttcggcccgaccttgtccttccaactgctcgatcctcatatgaagttccggcagctggaatcccctaaccttcgccagctgctgtcctggatcgacttggaattcaaccacccgcagatcttcattgtcgagaacggctggttcgtgtccgggaccaccaagcgcgacgacgccaagtacatgtattatctcaaaaagttcatcatggaaaccctcaaggccatcaaattggatggcgtggacgtgatcggatatacggcgtggagcctgatggacggtttcgagtggcaccgcggatacagcatccgcagaggactcttctacgtggacttcctgtcgcaagacaagatgctgctgcctaagagcagcgcgctgttctaccaaaagctcattgagaagaacgggttcccgcccctgccggagaaccagcctctggaagggaccttcccttgcgacttcgcctggggagtggtggacaactacatccaggtcgataccactctgagccagttcaccgacctgaacgtgtacctgtgggacgtgcatcacagcaagaggctcattaaggtcgacggagtggtcaccaagaagagaaagtcgtactgcgtggatttcgccgcaatccagccacagatcgccctgctgcaagagatgcacgtgacccatttccgcttctccctggattgggccctgattctcccgctggggaaccagtcgcaagtgaaccacactatcctgcaatactaccggtgcatggcttccgagctcgtccgcgtgaatatcacccccgtggtggcgctctggcagcctatggccccgaaccagggactgccacgactgctggccagacagggagcgtgggaaaacccgtacacagcactggcctttgcggagtacgcccggctgtgcttccaggaacttgggcatcacgtcaagctttggattactatgaacgaaccctacactaggaacatgacttactcagccggacataaccttctgaaggcacacgccctcgcttggcacgtgtacaacgaaaagttcagacacgctcagaacggaaagatttccatcgcgctgcaagcagactggatcgagcccgcctgccctttctcccaaaaagacaaggaagtggccgaacgggtgctggaattcgacatcggatggctggccgaacccatcttcggctccggcgattatccatgggtcatgcgggactggctcaaccagcgcaacaactttttgctgccatacttcaccgaagatgagaagaagctgatccagggcacctttgatttcctggcgctgagccactacactacgattctggtggacagcgaaaaggaggacccgattaagtacaacgactacctggaagtccaggaaatgaccgatattacttggctgaactcacctagccaagtggcggtggtgccttggggactgagaaaggtcctcaactggctcaaattcaaatacggagatctgcccatgtacatcatctccaatgggatcgacgacggcctgcatgctgaggacgatcagctccgcgtgtactatatgcagaactacattaacgaggcactgaaggcccatattctggacggcattaacctctgcggttattttgcctactcgttcaacgaccggactgccccccgcttcgggttgtaccgctacgccgcggatcagtttgagccaaaggcctccatgaagcattaccgcaagatcattgattccaatggatttccgggccccgaaaccctcgaacggttctgtccggaagagttcaccgtgtgtaccgagtgctccttctttcacacccgcaagagcgggggtggcggaagcggtggcggaggaagcgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtcagcaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaa

SEQ ID NO: 88 - DNA, 2358 bp, Artificial Sequence
  DNA_Native_Secreted_Iso2_SS_34_549_GS_IgG1_noCH1_Fc_Fusion
atgccagcttccgccccccctcggcggcctagacccccacctccctccctgtcgctgctgctggtgctgctcggtctgggcggacggagactcagggccgagcctggcgacggcgcacagacctgggcccggttctcacgccccccggccccggaagccgccggactgtttcagggaaccttccccgacggattcctgtgggccgtgggtagcgcggcgtaccagactgagggcggatggcagcagcacggaaagggagcctcaatttgggatactttcactcatcatcccctcgccccgccgggggattcgcggaacgcctccctccccctgggtgctcctagcccgctgcagccagccaccggcgacgtggcatccgacagctacaacaacgtgttccgggacaccgaggccctgagggaactgggagtgactcactaccgcttttcgatctcctgggcacgcgtgctcccgaacggatcggcgggagtgccgaatcgcgagggcctgcggtactaccgacggctgctggaaaggctcagagaactgggcgtgcagcctgtcgtgactctttaccactgggatctgccccaacggctgcaggatgcttacgggggatgggccaatagagccctggctgatcacttccgcgactacgccgaattgtgcttccggcacttcggtggccaagtcaagtactggattaccatcgacaacccatacgtcgtggcgtggcacggatacgcaaccggtcggctggcccctggtattcgcgggtccccgcggcttggatacctggtggcccacaacctgttgctcgcgcatgccaaagtctggcacctgtacaacacctcgttccggccgacccagggtggacaagtgtccatcgccctgtcgtcacactggatcaacccgcggagaatgaccgaccactccatcaaggaatgccagaagtccctcgatttcgtgttgggctggtttgccaagcctgtgtttattgacggagactaccccgagtccatgaagaacaacctgtcgtctatcctgcccgatttcactgaatccgagaaaaagtttatcaagggaaccgctgacttcttcgccctctgtttcggcccgaccttgtccttccaactgctcgatcctcatatgaagttccggcagctggaatcccctaaccttcgccagctgctgtcctggatcgacttggaattcaaccacccgcagatcttcattgtcgagaacggctggttcgtgtccgggaccaccaagcgcgacgacgccaagtacatgtattatctcaaaaagttcatcatggaaaccctcaaggccatcaaattggatggcgtggacgtgatcggatatacggcgtggagcctgatggacggtttcgagtggcaccgcggatacagcatccgcagaggactcttctacgtggacttcctgtcgcaagacaagatgctgctgcctaagagcagcgcgctgttctaccaaaagctcattgagaagaacgggttcccgcccctgccggagaaccagcctctggaagggaccttcccttgcgacttcgcctggggagtggtcgacaactacattcaagtgtcccagcttactaagccaatcagcagcctgactaagccataccacggcgggggagggtcgggcggaggcggatccgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtcagcaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaa

SEQ ID NO: 89 - DNA, 99 bp, Homo sapiens
atgcctgcttccgccccgcctagaaggcctcggcctcctccccccagcctgtctctgctcttggtgctgctgggactgggtggacggcgccttcgcgca

SEQ ID NO: 90 - DNA, 99 bp, Homo sapiens
atgccagcttccgccccccctcggcggcctagacccccacctccctccctgtcgctgctgctggtgctgctcggtctgggcggacggagactcagggcc

SEQ ID NO: 91 - DNA, 2844 bp, Homo sapiens
gagcctggcgacggcgcccagacctgggcccgggtgtcgaggccgccagcgcccgaggccgccggactgttccagggaaccttccctgatgggttcctctgggccgtgggctcagccgcataccagaccgaggggggctggcagcagcacggaaagggcgccagcatatgggacacgttcacccaccacccgctggctccgcccggggactccagaaacgcctccttgcccctcggtgctccttcgccactgcaacccgcaaccggcgacgtggccagcgattcatacaacaacgtgttccgggacaccgaggccctgagggaactgggagtgactcactaccgcttttcgatctcctgggcacgcgtgctcccgaacggatcggcgggagtgccgaatcgcgagggcctgcggtactaccgacggctgctggaaaggctcagagaactgggcgtgcagcctgtcgtgactctttaccactgggatctgccccaacggctgcaggatgcttacgggggatgggccaatagagccctggctgatcacttccgcgactacgccgaattgtgcttccggcacttcggtggccaagtcaagtactggattaccatcgacaacccatacgtcgtggcgtggcacggatacgcaaccggtcggctggcccctggtattcgcgggtccccgcggcttggatacctggtggcccacaacctgttgctcgcgcatgccaaagtctggcacctgtacaacacctcgttccggccgacccagggtggacaagtgtccatcgccctgtcgtcacactggatcaacccgcggagaatgaccgaccactccatcaaggaatgccagaagtccctcgatttcgtgttgggctggtttgccaagcctgtgtttattgacggagactaccccgagtccatgaagaacaacctgtcgtctatcctgcccgatttcactgaatccgagaaaaagtttatcaagggaaccgctgacttcttcgccctctgtttcggcccgaccttgtccttccaactgctcgatcctcatatgaagttccggcagctggaatcccctaaccttcgccagctgctgtcctggatcgacttggaattcaaccacccgcagatcttcattgtcgagaacggctggttcgtgtccgggaccaccaagcgcgacgacgccaagtacatgtattatctcaaaaagttcatcatggaaaccctcaaggccatcaaattggatggcgtggacgtgatcggatatacggcgtggagcctgatggacggtttcgagtggcaccgcggatacagcatccgcagaggactcttctacgtggacttcctgtcgcaagacaagatgctgctgcctaagagcagcgcgctgttctaccaaaagctcattgagaagaacgggttcccgcccctgccggagaaccagcctctggaagggaccttcccttgcgacttcgcctggggagtggtggacaactacatccaggtcgataccactctgagccagttcaccgacctgaacgtgtacctgtgggacgtgcatcacagcaagaggctcattaaggtcgacggagtggtcaccaagaagagaaagtcgtactgcgtggatttcgccgcaatccagccacagatcgccctgctgcaagagatgcacgtgacccatttccgcttctccctggattgggccctgattctcccgctggggaaccagtcgcaagtgaaccacactatcctgcaatactaccggtgcatggcttccgagctcgtccgcgtgaatatcacccccgtggtggcgctctggcagcctatggccccgaaccagggactgccacgactgctggccagacagggagcgtgggaaaacccgtacacagcactggcctttgcggagtacgcccggctgtgcttccaggaacttgggcatcacgtcaagctttggattactatgaacgaaccctacactaggaacatgacttactcagccggacataaccttctgaaggcacacgccctcgcttggcacgtgtacaacgaaaagttcagacacgctcagaacggaaagatttccatcgcgctgcaagcagactggatcgagcccgcctgccctttctcccaaaaagacaaggaagtggccgaacgggtgctggaattcgacatcggatggctggccgaacccatcttcggctccggcgattatccatgggtcatgcgggactggctcaaccagcgcaacaactttttgctgccatacttcaccgaagatgagaagaagctgatccagggcacctttgatttcctggcgctgagccactacactacgattctggtggacagcgaaaaggaggacccgattaagtacaacgactacctggaagtccaggaaatgaccgatattacttggctgaactcacctagccaagtggcggtggtgccttggggactgagaaaggtcctcaactggctcaaattcaaatacggagatctgcccatgtacatcatctccaatgggatcgacgacggcctgcatgctgaggacgatcagctccgcgtgtactatatgcagaactacattaacgaggcactgaaggcccatattctggacggcattaacctctgcggttattttgcctactcgttcaacgaccggactgccccccgcttcgggttgtaccgctacgccgcggatcagtttgagccaaaggcctccatgaagcattaccgcaagatcattgattccaatggatttccgggccccgaaaccctcgaacggttctgtccggaagagttcaccgtgtgtaccgagtgctccttctttcacacccgcaagagc

SEQ ID NO: 92 - DNA, 1548 bp, Homo sapiens
gagcctggcgacggcgcacagacctgggcccggttctcacgccccccggccccggaagccgccggactgtttcagggaaccttccccgacggattcctgtgggccgtgggtagcgcggcgtaccagactgagggcggatggcagcagcacggaaagggagcctcaatttgggatactttcactcatcatcccctcgccccgccgggggattcgcggaacgcctccctccccctgggtgctcctagcccgctgcagccagccaccggcgacgtggcatccgacagctacaacaacgtgttccgggacaccgaggccctgagggaactgggagtgactcactaccgcttttcgatctcctgggcacgcgtgctcccgaacggatcggcgggagtgccgaatcgcgagggcctgcggtactaccgacggctgctggaaaggctcagagaactgggcgtgcagcctgtcgtgactctttaccactgggatctgccccaacggctgcaggatgcttacgggggatgggccaatagagccctggctgatcacttccgcgactacgccgaattgtgcttccggcacttcggtggccaagtcaagtactggattaccatcgacaacccatacgtcgtggcgtggcacggatacgcaaccggtcggctggcccctggtattcgcgggtccccgcggcttggatacctggtggcccacaacctgttgctcgcgcatgccaaagtctggcacctgtacaacacctcgttccggccgacccagggtggacaagtgtccatcgccctgtcgtcacactggatcaacccgcggagaatgaccgaccactccatcaaggaatgccagaagtccctcgatttcgtgttgggctggtttgccaagcctgtgtttattgacggagactaccccgagtccatgaagaacaacctgtcgtctatcctgcccgatttcactgaatccgagaaaaagtttatcaagggaaccgctgacttcttcgccctctgtttcggcccgaccttgtccttccaactgctcgatcctcatatgaagttccggcagctggaatcccctaaccttcgccagctgctgtcctggatcgacttggaattcaaccacccgcagatcttcattgtcgagaacggctggttcgtgtccgggaccaccaagcgcgacgacgccaagtacatgtattatctcaaaaagttcatcatggaaaccctcaaggccatcaaattggatggcgtggacgtgatcggatatacggcgtggagcctgatggacggtttcgagtggcaccgcggatacagcatccgcagaggactcttctacgtggacttcctgtcgcaagacaagatgctgctgcctaagagcagcgcgctgttctaccaaaagctcattgagaagaacgggttcccgcccctgccggagaaccagcctctggaagggaccttcccttgcgacttcgcctggggagtggtcgacaactacattcaagtgtcccagcttactaagccaatcagcagcctgactaagccataccac

SEQ ID NO: 93 - DNA, 2838 bp, Homo sapiens
ggcgacggcgcccagacctgggcccgggtgtcgaggccgccagcgcccgaggccgccggactgttccagggaaccttccctgatgggttcctctgggccgtgggctcagccgcataccagaccgaggggggctggcagcagcacggaaagggcgccagcatatgggacacgttcacccaccacccgctggctccgcccggggactccagaaacgcctccttgcccctcggtgctccttcgccactgcaacccgcaaccggcgacgtggccagcgattcatacaacaacgtgttccgggacaccgaggccctgagggaactgggagtgactcactaccgcttttcgatctcctgggcacgcgtgctcccgaacggatcggcgggagtgccgaatcgcgagggcctgcggtactaccgacggctgctggaaaggctcagagaactgggcgtgcagcctgtcgtgactctttaccactgggatctgccccaacggctgcaggatgcttacgggggatgggccaatagagccctggctgatcacttccgcgactacgccgaattgtgcttccggcacttcggtggccaagtcaagtactggattaccatcgacaacccatacgtcgtggcgtggcacggatacgcaaccggtcggctggcccctggtattcgcgggtccccgcggcttggatacctggtggcccacaacctgttgctcgcgcatgccaaagtctggcacctgtacaacacctcgttccggccgacccagggtggacaagtgtccatcgccctgtcgtcacactggatcaacccgcggagaatgaccgaccactccatcaaggaatgccagaagtccctcgatttcgtgttgggctggtttgccaagcctgtgtttattgacggagactaccccgagtccatgaagaacaacctgtcgtctatcctgcccgatttcactgaatccgagaaaaagtttatcaagggaaccgctgacttcttcgccctctgtttcggcccgaccttgtccttccaactgctcgatcctcatatgaagttccggcagctggaatcccctaaccttcgccagctgctgtcctggatcgacttggaattcaaccacccgcagatcttcattgtcgagaacggctggttcgtgtccgggaccaccaagcgcgacgacgccaagtacatgtattatctcaaaaagttcatcatggaaaccctcaaggccatcaaattggatggcgtggacgtgatcggatatacggcgtggagcctgatggacggtttcgagtggcaccgcggatacagcatccgcagaggactcttctacgtggacttcctgtcgcaagacaagatgctgctgcctaagagcagcgcgctgttctaccaaaagctcattgagaagaacgggttcccgcccctgccggagaaccagcctctggaagggaccttcccttgcgacttcgcctggggagtggtggacaactacatccaggtcgataccactctgagccagttcaccgacctgaacgtgtacctgtgggacgtgcatcacagcaagaggctcattaaggtcgacggagtggtcaccaagaagagaaagtcgtactgcgtggatttcgccgcaatccagccacagatcgccctgctgcaagagatgcacgtgacccatttccgcttctccctggattgggccctgattctcccgctggggaaccagtcgcaagtgaaccacactatcctgcaatactaccggtgcatggcttccgagctcgtccgcgtgaatatcacccccgtggtggcgctctggcagcctatggccccgaaccagggactgccacgactgctggccagacagggagcgtgggaaaacccgtacacagcactggcctttgcggagtacgcccggctgtgcttccaggaacttgggcatcacgtcaagctttggattactatgaacgaaccctacactaggaacatgacttactcagccggacataaccttctgaaggcacacgccctcgcttggcacgtgtacaacgaaaagttcagacacgctcagaacggaaagatttccatcgcgctgcaagcagactggatcgagcccgcctgccctttctcccaaaaagacaaggaagtggccgaacgggtgctggaattcgacatcggatggctggccgaacccatcttcggctccggcgattatccatgggtcatgcgggactggctcaaccagcgcaacaactttttgctgccatacttcaccgaagatgagaagaagctgatccagggcacctttgatttcctggcgctgagccactacactacgattctggtggacagcgaaaaggaggacccgattaagtacaacgactacctggaagtccaggaaatgaccgatattacttggctgaactcacctagccaagtggcggtggtgccttggggactgagaaaggtcctcaactggctcaaattcaaatacggagatctgcccatgtacatcatctccaatgggatcgacgacggcctgcatgctgaggacgatcagctccgcgtgtactatatgcagaactacattaacgaggcactgaaggcccatattctggacggcattaacctctgcggttattttgcctactcgttcaacgaccggactgccccccgcttcgggttgtaccgctacgccgcggatcagtttgagccaaaggcctccatgaagcattaccgcaagatcattgattccaatggatttccgggccccgaaaccctcgaacggttctgtccggaagagttcaccgtgtgtaccgagtgctccttctttcacacccgcaagagc

SEQ ID NO: 94 - DNA, 1542 bp, Homo sapiens
ggcgacggcgcacagacctgggcccggttctcacgccccccggccccggaagccgccggactgtttcagggaaccttccccgacggattcctgtgggccgtgggtagcgcggcgtaccagactgagggcggatggcagcagcacggaaagggagcctcaatttgggatactttcactcatcatcccctcgccccgccgggggattcgcggaacgcctccctccccctgggtgctcctagcccgctgcagccagccaccggcgacgtggcatccgacagctacaacaacgtgttccgggacaccgaggccctgagggaactgggagtgactcactaccgcttttcgatctcctgggcacgcgtgctcccgaacggatcggcgggagtgccgaatcgcgagggcctgcggtactaccgacggctgctggaaaggctcagagaactgggcgtgcagcctgtcgtgactctttaccactgggatctgccccaacggctgcaggatgcttacgggggatgggccaatagagccctggctgatcacttccgcgactacgccgaattgtgcttccggcacttcggtggccaagtcaagtactggattaccatcgacaacccatacgtcgtggcgtggcacggatacgcaaccggtcggctggcccctggtattcgcgggtccccgcggcttggatacctggtggcccacaacctgttgctcgcgcatgccaaagtctggcacctgtacaacacctcgttccggccgacccagggtggacaagtgtccatcgccctgtcgtcacactggatcaacccgcggagaatgaccgaccactccatcaaggaatgccagaagtccctcgatttcgtgttgggctggtttgccaagcctgtgtttattgacggagactaccccgagtccatgaagaacaacctgtcgtctatcctgcccgatttcactgaatccgagaaaaagtttatcaagggaaccgctgacttcttcgccctctgtttcggcccgaccttgtccttccaactgctcgatcctcatatgaagttccggcagctggaatcccctaaccttcgccagctgctgtcctggatcgacttggaattcaaccacccgcagatcttcattgtcgagaacggctggttcgtgtccgggaccaccaagcgcgacgacgccaagtacatgtattatctcaaaaagttcatcatggaaaccctcaaggccatcaaattggatggcgtggacgtgatcggatatacggcgtggagcctgatggacggtttcgagtggcaccgcggatacagcatccgcagaggactcttctacgtggacttcctgtcgcaagacaagatgctgctgcctaagagcagcgcgctgttctaccaaaagctcattgagaagaacgggttcccgcccctgccggagaaccagcctctggaagggaccttcccttgcgacttcgcctggggagtggtcgacaactacattcaagtgtcccagcttactaagccaatcagcagcctgactaagccataccac

SEQ ID NO: 95 - DNA, 2553 bp, Homo sapiens
aacgtgttccgggacaccgaggccctgagggaactgggagtgactcactaccgcttttcgatctcctgggcacgcgtgctcccgaacggatcggcgggagtgccgaatcgcgagggcctgcggtactaccgacggctgctggaaaggctcagagaactgggcgtgcagcctgtcgtgactctttaccactgggatctgccccaacggctgcaggatgcttacgggggatgggccaatagagccctggctgatcacttccgcgactacgccgaattgtgcttccggcacttcggtggccaagtcaagtactggattaccatcgacaacccatacgtcgtggcgtggcacggatacgcaaccggtcggctggcccctggtattcgcgggtccccgcggcttggatacctggtggcccacaacctgttgctcgcgcatgccaaagtctggcacctgtacaacacctcgttccggccgacccagggtggacaagtgtccatcgccctgtcgtcacactggatcaacccgcggagaatgaccgaccactccatcaaggaatgccagaagtccctcgatttcgtgttgggctggtttgccaagcctgtgtttattgacggagactaccccgagtccatgaagaacaacctgtcgtctatcctgcccgatttcactgaatccgagaaaaagtttatcaagggaaccgctgacttcttcgccctctgtttcggcccgaccttgtccttccaactgctcgatcctcatatgaagttccggcagctggaatcccctaaccttcgccagctgctgtcctggatcgacttggaattcaaccacccgcagatcttcattgtcgagaacggctggttcgtgtccgggaccaccaagcgcgacgacgccaagtacatgtattatctcaaaaagttcatcatggaaaccctcaaggccatcaaattggatggcgtggacgtgatcggatatacggcgtggagcctgatggacggtttcgagtggcaccgcggatacagcatccgcagaggactcttctacgtggacttcctgtcgcaagacaagatgctgctgcctaagagcagcgcgctgttctaccaaaagctcattgagaagaacgggttcccgcccctgccggagaaccagcctctggaagggaccttcccttgcgacttcgcctggggagtggtggacaactacatccaggtcgataccactctgagccagttcaccgacctgaacgtgtacctgtgggacgtgcatcacagcaagaggctcattaaggtcgacggagtggtcaccaagaagagaaagtcgtactgcgtggatttcgccgcaatccagccacagatcgccctgctgcaagagatgcacgtgacccatttccgcttctccctggattgggccctgattctcccgctggggaaccagtcgcaagtgaaccacactatcctgcaatactaccggtgcatggcttccgagctcgtccgcgtgaatatcacccccgtggtggcgctctggcagcctatggccccgaaccagggactgccacgactgctggccagacagggagcgtgggaaaacccgtacacagcactggcctttgcggagtacgcccggctgtgcttccaggaacttgggcatcacgtcaagctttggattactatgaacgaaccctacactaggaacatgacttactcagccggacataaccttctgaaggcacacgccctcgcttggcacgtgtacaacgaaaagttcagacacgctcagaacggaaagatttccatcgcgctgcaagcagactggatcgagcccgcctgccctttctcccaaaaagacaaggaagtggccgaacgggtgctggaattcgacatcggatggctggccgaacccatcttcggctccggcgattatccatgggtcatgcgggactggctcaaccagcgcaacaactttttgctgccatacttcaccgaagatgagaagaagctgatccagggcacctttgatttcctggcgctgagccactacactacgattctggtggacagcgaaaaggaggacccgattaagtacaacgactacctggaagtccaggaaatgaccgatattacttggctgaactcacctagccaagtggcggtggtgccttggggactgagaaaggtcctcaactggctcaaattcaaatacggagatctgcccatgtacatcatctccaatgggatcgacgacggcctgcatgctgaggacgatcagctccgcgtgtactatatgcagaactacattaacgaggcactgaaggcccatattctggacggcattaacctctgcggttattttgcctactcgttcaacgaccggactgccccccgcttcgggttgtaccgctacgccgcggatcagtttgagccaaaggcctccatgaagcattaccgcaagatcattgattccaatggatttccgggccccgaaaccctcgaacggttctgtccggaagagttcaccgtgtgtaccgagtgctccttctttcacacccgcaagagc

SEQ ID NO: 96 - DNA, 1257 bp, Homo sapiens
aacgtgttccgggacaccgaggccctgagggaactgggagtgactcactaccgcttttcgatctcctgggcacgcgtgctcccgaacggatcggcgggagtgccgaatcgcgagggcctgcggtactaccgacggctgctggaaaggctcagagaactgggcgtgcagcctgtcgtgactctttaccactgggatctgccccaacggctgcaggatgcttacgggggatgggccaatagagccctggctgatcacttccgcgactacgccgaattgtgcttccggcacttcggtggccaagtcaagtactggattaccatcgacaacccatacgtcgtggcgtggcacggatacgcaaccggtcggctggcccctggtattcgcgggtccccgcggcttggatacctggtggcccacaacctgttgctcgcgcatgccaaagtctggcacctgtacaacacctcgttccggccgacccagggtggacaagtgtccatcgccctgtcgtcacactggatcaacccgcggagaatgaccgaccactccatcaaggaatgccagaagtccctcgatttcgtgttgggctggtttgccaagcctgtgtttattgacggagactaccccgagtccatgaagaacaacctgtcgtctatcctgcccgatttcactgaatccgagaaaaagtttatcaagggaaccgctgacttcttcgccctctgtttcggcccgaccttgtccttccaactgctcgatcctcatatgaagttccggcagctggaatcccctaaccttcgccagctgctgtcctggatcgacttggaattcaaccacccgcagatcttcattgtcgagaacggctggttcgtgtccgggaccaccaagcgcgacgacgccaagtacatgtattatctcaaaaagttcatcatggaaaccctcaaggccatcaaattggatggcgtggacgtgatcggatatacggcgtggagcctgatggacggtttcgagtggcaccgcggatacagcatccgcagaggactcttctacgtggacttcctgtcgcaagacaagatgctgctgcctaagagcagcgcgctgttctaccaaaagctcattgagaagaacgggttcccgcccctgccggagaaccagcctctggaagggaccttcccttgcgacttcgcctggggagtggtcgacaactacattcaagtgtcccagcttactaagccaatcagcagcctgactaagccataccac

SEQ ID NO: 97 - DNA, 30 bp, Artificial Sequence
  DNA_GS_linker1
gggggtggcggaagcggtggcggaggaagc

SEQ ID NO: 98 - DNA, 30 bp, Artificial Sequence
  DNA_GS_Linker_iso2
ggcgggggagggtcgggcggaggcggatcc

SEQ ID NO: 99 - DNA, 681 bp, Artificial Sequence
  DNA_ IgG1_noCH1_Fc_Fusion
gacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtcagcaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaa

SEQ ID NO: 100 - DNA, 57 bp, Artificial Sequence
  DNA_Synthetic_SS
atggctcggctgacagtcctggccctgctggctggtctgctggcgtcctcgagggcc

SEQ ID NO: 101 - DNA, 120 bp, Artificial Sequence
  DNA_TwinStrep_tag
ggcggagaaaacctttacttccaatcctctgcctggagccacccccagtttgaaaagggcggcggctcagggggcggatccgggggatcatccgcctggtcccatccgcaattcgagaag

SEQ ID NO: 102 - protein, 32 aa, Artificial Sequence
  Protein_TwinStrep_Tag_2
SSAWSHPQFEKGGGSGGGSGGSSAWSHPQFEK

SEQ ID NO: 103 - protein, 29 aa, Artificial Sequence
  Protein_TwinStrep_Tag_3
WSHPQFEKGGGSGGGSGGSSAWSHPQFEK

SEQ ID NO: 104 - protein, 8 aa, Artificial Sequence
  Strep_Tag
WSHPQFEK

SEQ ID NO: 105 - protein, 11 aa, Artificial Sequence
  Protein_Strep_Tag_Linker
GGENLYFQSSA

SEQ ID NO: 106 - protein, 8 aa, Artificial Sequence
  Protein_Strep_Tag_Linker_2
GGENLYFQ

SEQ ID NO: 107 - protein, 516 aa, Homo sapiens
EPGDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVSQLTKPISSLTKPYH

SEQ ID NO: 108 - protein, 516 aa, Homo sapiens
EPGDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVSQLTKPISSLTKPYH

SEQ ID NO: 109 - protein, 516 aa, Homo sapiens
EPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVSQLTKPISSLTKPYH

SEQ ID NO: 110 - protein, 516 aa, Homo sapiens
EPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALSFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVSQLTKPISSLTKPYH

SEQ ID NO: 111 - protein, 864 aa, Canis familiaris
MATCILQMRFLRLGKILFHSSPQSTGGSGGTRGPRAPAQLRTQRGTDKLVAKSELKAKTAHRALADHFRDYAELCFRHFCGQVKYWITIDNPYVVAWHGYATGRLAPGVRGSPRLGYLVAHNLLLAHAKIWHLYNTSFRPTQGGQVSIALSSHWINPRRMTDHSIKECQKSLDFVLGWFAKPIFIDGDYPESMKNNLSSLLPVFTESEKKFIKGTADFFALSFGPTLSFQLLDPHMKFHQLESPSLRQLLSWIDLEYNHPQIFIVENGWFVSGTTKRDDAKYMYYLKKFIMETLKAIRLDGVDVIGYTAWSLMDGFEWHRGYSIRRGLFYVDFLSQDKKLLPKSSALFYQKLIEKNGFPPLPENQPLEGTFPCDFAWGIVDNYIQVDTTLSQFTDPNVYLWDVHHSKRLIKVDGLRAKKRKPYCVDFAAIGPQVALLQEMHVSHFHFSLDWALLLPLGNQSRVNHAALHYYGCVASELLRANITPVVALWRPAAAHQGLPGPLAQRGAWENPRTALAFAEYARLCFRALGRHVKVWITLREPPTRNLTLRAGHNLLRAHALAWRVYDEQFRGSQQGKVSIALQADWVEPACPSSQKDREVAERVLEFDVGWLAEPIFGSGDYPRLMRDWLTRRDHSLLPYFTDEEKRLIRGSFDFLALSHYTTILVDWEKEDPVKYNDYLEVQEMTDITWLNSPSQVAVVPWGLRKVLNWLKFKYGDLPMYIVSNGIDDDPRAAQDSLRVYYMQNYVNEALKAYVLDGINLCGYFAYSFNDRTAPKFGLYHYAANQFEPKPSVKHYRKIIDNNGFPGPETLGRFCPEEFTLCTECSFFHTRKSLLAFIAFLLFAFIISLSLIFYYSRKGRRSYK

SEQ ID NO: 112 - protein, 705 aa, Felis catus
MTDHSIKECQKSLDFVLGWFAKPIFIDGDYPESMKNNLSHLLPDFTEAEKKFIKGTADFFALSFGPTLSFQLLDPHMKFRQLESPSLRQLLSWIDLEYNHPQIFIVENGWFVSGTTKRDDAKYMYYLKKFVMETLKAIRLDGVDVIGYTAWSLMDGFEWHRGYSIRRGLFYVDFLSQDKKLLPKSSALFYQKLIEKNGFPPLPENQPLEGTFPCDFAWGIVDNYIQVDTTLSQFTDPNVYLWDVHHSKRLIKVDGVVTKKRKSYCVDFAAIRPQIALLQEMHVSHFHFSLDWALILPLGNQSQVNHTVLDYYRCVVSELVRANITPVVALWRPAAPHQGLPRPLAKHGAWENPHTASAFAEYARLCFKDLGHHVKFWITMGEPYTRNMTYSAGHNLLKAHALAWRVYDENFRGSQKGKISIALQADWIEPACPFSQKDKEVAERVLEFDIGWLAEPIFGSGDYPRVMRDWLTQRNNFLLPYFTEDEKKLIRGSFDFLAVSHYTTILVDWEKEDPMKYNDYLEVQEMTDITWLNSPSQVAVVPWGLRKILNWLKLKYGDLPMYIISNGIDDDPQAAQDKLRVYYMQNYVNEALKAYVLDGVNLCGYFAYSFNDRTAPKFGFYHYAANQFEPKPSMKHYRKMIDSNGFSGPDTLGRFCPEEFTLCTECGFFHTRKSLLAFIAFLLFAFIISLSLIFYYSKKGKRSYK

SEQ ID NO: 113 - protein, 705 aa, Felis catus; identical to SEQ ID NO: 112

SEQ ID NO: 114 - protein, 754 aa, Felis catus
MRDLCYITWSRGTVQAHAKIWHLYNTSFRPTQGGQVSIALSSHWINPRRMTDHSIKECQKSLDFVLGWFAKPIFIDGDYPESMKNNLSHLLPDFTEAEKKFIKGTADFFALSFGPTLSFQLLDPHMKFRQLESPSLRQLLSWIDLEYNHPQIFIVENGWFVSGTTKRDDAKYMYYLKKFVMETLKAIRLDGVDVIGYTAWSLMDGFEWHRGYSIRRGLFYVDFLSQDKKLLPKSSALFYQKLIEKNGFPPLPENQPLEGTFPCDFAWGIVDNYIQVDTTLSQFTDPNVYLWDVHHSKRLIKVDGVVTKKRKSYCVDFAAIRPQIALLQEMHVSHFHFSLDWALILPLGNQSQVNHTVLDYYRCVVSELVRANITPVVALWRPAAPHQGLPRPLAKHGAWENPHTASAFAEYARLCFKDLGHHVKFWITMGEPYTRNMTYSAGHNLLKAHALAWRVYDENFRGSQKGKISIALQADWIEPACPFSQKDKEVAERVLEFDIGWLAEPIFGSGDYPRVMRDWLTQRNNFLLPYFTEDEKKLIRGSFDFLAVSHYTTILVDWEKEDPMKYNDYLEVQEMTDITWLNSPSQVAVVPWGLRKILNWLKLKYGDLPMYIISNGIDDDPQAAQDKLRVYYMQNYVNEALKAYVLDGVNLCGYFAYSFNDRTAPKFGFYHYAANQFEPKPSMKHYRKMIDSNGFSGPDTLGRFCPEEFTLCTECGFFHTRKSLLAFIAFLLFAFIISLSLIFYYSKKGKRSYK

SEQ ID NO: 115 - protein, 1012 aa, Sus scrofa; identical to SEQ ID NO: 1

SEQ ID NO: 116 - protein, 1013 aa, Bos taurus
MPARAPPRRLRAFPPPPPPLWLLLLALGGRPLRAEPGDGAQTWARFARPPTPEAAGLLHDTFPDGFLWAVGSAAYQTEGGWQQHGKGASIWDTFTHRPPAPPGDPSAAGWPSGAPSPPPPATGDVASDGYNNVFRDTEGLRELGVTHYRFSISWARVLPNGSASAPNREGLRYYRRLLERLRELGVQPVVTLYHWDLPQRLQDAYGGWANRALADHFRDYAELCFRHFGGQVKYWITIDNPYVVAWHGYATGRLAPGVRGSPRLGYLVAHNLLLAHAKIWHLYDTSFRPTQGGQVSIALSSHWISPRRMTEHSIQECQKSLDFVLGWFAKPIFIDGDYPESMKNNLSSLLPDFTESEKKFIKGTADFFALSFGPTLSFQLLDPQMKFRQLESPSLRQLLSWIDLEYNHPQIFIVENGWFVSGTTKRDDAKYMYYLKKFIMETLKAIRLDGVDVIGYTAWSLMDGFEWHRGYSIRRGLFYVDFLSQDKKLLPKSSALFYQKLIENNGFPPLPENQPLEGTFPCDFAWGVVDNCIQVDTTLSQFIDPNVYLWDVHRSKRLIKVDGVLTKTRKSYCVDFAAIRPQIALLQEMHVTHFHFSLDWALILPLGNRSQVNRTVLGFYRCVASELVRANITPVVALWRPAAPHQGLPAPLARHGAWENPHTALAFAEYASLCFQDLGRHVKFWITMHEPSTRNMTYSAGHNLLKAHALAWRTYDERFRRSQKGKISIALQADWIEPACPFSPEDREVAERVLEFDIGWLAEPIFGSGDYPRVMRDWLNQRNNFLLPYFTDEEKKLIRGSFDFLALSHYTTILVDWEKEDPIKYNDYLAVQEMTDITWLNSPSQVAVVPWGLRKVLNWLKAKYGDLPMYIISNGIDDDPHAAQDNLRVYYMQTYVNEALKAYILDGINLCGYFAYSFNDRTAPKFGLYRYAANQFEPKPSMKHYRKIIDNNGFPGPETLGRFCPEEFTLCTECSFFHTRKSLLAFIAFLLFAFVISLSLIFYYSKKGRRGYK

SEQ ID NO: 117 - protein, 1010 aa, Ovis aries
  misc_feature (63)..(63): Xaa can be any naturally occurring amino acid
MPARARRALGPSRLPAAAARLWLLLPGLGRPALRARPGDGAQTWARFARPPNPRGRGLLHDTXPDGFSWAVGSAAYQTEGGWQQHGKGASHLGHVHHRPPAPPGDPSRPGWPSGAPSPPPRPPSGDVASDGYNNVFRDTEGLRELGVTHYRFSISWARVLPNGSASAPNREGLRYYRRLLERLRELGVQPVVTLSHWALPQLLQDAYGGWANRALADHFRDYAELCFRHFGGQVKYWITIDNPYVVAWHGYATGRLAPGGRGSPRLHNLLLAHAKIWHLYDTSFRPTQGGQVSIALSSHWISPRRMTEHSIKECQKSLDFVLGWFAKPIFIDGDYPESMKNNLSSLLPDFTESEKKFIKGTADFFALSFGPTLSFQLLDPQMKFRQLESPSLRQLLSWIDLEYNHPQIFIVENGWFVSGTTKRDDAKYMYYLKKFIMETLKAIRLDGVDVIGYTAWSLMDGFEWHRGYSIRRGLFYVDFLSQDKKLLPKSSALFYQKLIENNGFPPLPENQPLEGTFPCDFAWGVVDNCIQVDTTLSQFIDPNVYLWDVHRSKRLIKVDGVLTKTRKSYCVDFAAIRPQIALLQEMHVTHFHFSLDWALILPLGNRSQVNRTVLGFYRCVASELVRANITPVVALWRPAAPHQGLPAPLARHGAWENPHTALAFAEYASLCFQDLGRHVKFWITMHEPSTRNMTYSAGHNLLKAHALAWRTYDERFRRSQKGKISIALQADWIEPACPFSPEDREVAERVLEFDIGWLAEPIFGSGDYPRVMRDWLNQRNNFLLPYFTDEEKKLIRGSFDFLALSHYTTILVDWEKEDPIKYNDYLAVQEMTDITWLNSPSQVAVVPWGLRKVLNWLKAKYGDLPMYIISNGIDDDPHAAQDNLRVYYMQNYVNEALKAYILDGINLCGYFAYSFNDRTAPKFGLYRYAANQFEPKPSMKHYRKIIDNNGFPGPETLGRFCPEEFTLCTECSFFHARKSLLAFIAFLLFAFVISLSLIFYYSKKGRRGYK

SEQ ID NO: 118 - protein, 983 aa, Equus caballus
  misc_feature (38)..(38): Xaa can be any naturally occurring amino acid
MSRKTRRAWGSPVHLSARSPAPEPRGLLTASFPDGFLXAVSSAAYQTEGGWRQHGKGASIWDTFTHHPPATPGGPQLSGLPSGGPSPSPLATGDVASDGYNNVFRDTEGLRELGVTHYRFSISWARVLPNGSAGAPNREGLRYYRRLLERLRELGVQPVVTLYHWDLPQRLQDAYGGWANRALADHFRDYAELCFRHFGGQVKYWITIDNPYVVAWHGYATGRLAPGVRGSPQLGYLVAHNLLLAHAKIWHLYNTSFRPTQGGQVSIALSSHWINPRRMTDHSIKECQKSLDFVLGWFAKPIFIDGDYPETMKNNLSSLLPDFTESEKKFIKGTADFFALSFGPTLSFQLLDPHMKFRQLESPSLRQLLSWIDLEYNHPQIFIVENGWFVSGTTKRDDAKYMYYLKKFIMETLKAIRLDGVDVIGYTAWSLMDGFEWHRGYSIRRGLFYVDFLSQDKKLLPKSSALFYQKLIEKNGFPPLPENQPLEGTFPCDFAWGVVDNYIQVDTTLSQFTDPNVYLWDVHHSKRLIKVDGLVAKKRTSYCVDFAAIRPQIALLQEMHVSHFHFALDWPLILPLGNQSQVNRTGLHYYRCVVSELVRANITPVVALWRPSPQHQGLPRLLAKHGAWENPHTALAFAEYARLCFQELGHHVKFWITMSEPYTRNMTYSAGHNLLKAHALAWRVYDDKFRHAQKGKISIALQADWIEPACPFSQQDKEGAERVLEFDIGWLAEPIFGSGDYPPVMRDWLNQRNNFLLPYFSEEEKKLIRGSFDFLALSHYTTILVDWEKEDPMKYNDYLEVQEMTDITWLNSPSQVAVVPWGLRKVLNWLKSKYGDLPMYIIANGIDDDPQEAQDRLRVYYMQNYVNEALKAYVLDGINLCGYFAYSFNDRTAPKFGLYRYAANQFEPKPSMKHYRKIIDNNGFPGPKTLGRFCPEEFTLCTECSFFHTRKSLLAFIAFLLFAFIISLSLIFYYSKKGRRNYK

SEQ ID NO: 119 - protein, 1005 aa, Oryctolagus cuniculus
MPVRARPLQLRLRLLLLALVGRLLRAEPGDGAQTWVRFARPPVPDAAGLLHDTFPDGFLWAVGSAAYQTEGGWQQHGKGESIWDTFTHHPPAPLGDLSITPLPSGTPSAPPAATGDVASDGYNNVLRDTEGLRELGVTHYRFSISWARVLPNGSASAPNREGLRYYRRLLERLRELGVQPVVTLYHWDLPQRLQDAYGGWANPSLADHFRDYAELCFRHFGSQVKYWITIDNPYVVAWHGYATGRLAPGIRGGARLGYLVAHNLLLAHAKIWHLYNTSFRPTQGGQVSIALGSHWIIPRRRTDHNIKECQKSLDFVLGWFARPIFIDGDYPESMKNNLSSLLPDFTEAEKKFIKGTADFFALSFGPTLSFQLLDPQMKFRQLESPSLRQLLSWIALEYNHPQIFIVENGWFVSGTTKRDDAKYMYYLKKFIMETLKAIRLDGVDVIGYTAWSLMDGFEWHRGYNIRRGLFYVDFLSQDKKLLPKSSALFYQKLIEKNGFPPLPENQPLEGTFPCDFAWGVVDNYIQVDTTLSQFTDPNVYLWDVHHSKRLIKLDGVVSRKRKSYCVDFAAIRSQIVLLQETHVTHFHFSLDWALVLPLGNQSQVNRTVLRYYRCVVEELVRANITPVVALWQPAAPHQGLPQPLAQQGAWENPHTVLAFVEYARLCFMELGHRIKFWITMNEPNTRNMTYRAGHHLLKAHALVWREYDGKFRPAQKGKVSIALQADWIEPACPFSQKDKEVAERVLEFDIGWLAEPIFGSGDYPRVMRDWLNQRNNFLLPYFTEEERQLVRGSFDFLALSHYTTILVDWEKEDPTKYNDYLEVQEMTDITWLNSPGQVAVVPWGLRKVLNWLRLKYGDLPMYVIANGIDDDLQAEQDQLRVYYIQNYVNEALKAYMLDGINLCGYFAYSLNDRSAPKFGLYRYAANQFEPKPSMKHYRRIIDNNGFPSSETLEEFCPEELSKCIECSFFHKRKSLLAFIAFLFFAFIISLSLIFYYSKKGRRSYK

SEQ ID NO: 120 - protein, 1013 aa, Capra aegagrus
MPARAPPRRLRALPPPPPPLWLLLLALGGRPLRAEPGDGAQTWARFARPPTPEAAGLLHDTFPDGFLWAVGSAAYQTEGGWQQHGKGASIWDTFTHRPPAPPGDPSAAGWPSGAPSPPPPATGDVASDGYNNVFRDTEGLRELGVTHYRFSISWARVLPNGSASAPNREGLRYYRRLLERLRELGVQPVVTLYHWDLPQLLQDAYGGWANRALADHFRDYAELCFRHFGGQVKYWITIDNPYVVAWHGYATGRLAPGVRGSPRLGYLVAHNLLLAHAKIWHLYDTSFRPTQGGQVSIALSSHWISPRRMTEHSIKECQKSLDFVLGWFAKPIFIDGDYPESMKNNLSSLLPDFTESEKKFIKGTADFFALSFGPTLSFQLLDPQMKFRQLESPSLRQLLSWIDLEYNHPQIFIVENGWFVSGTTKRDDAKYMYYLKKFIMETLKAIRLDGVDVIGYTAWSLMDGFEWHRGYSIRRGLFYVDFLSQDKKLLPKSSALFYQKLIENNGFPPLPENQPLEGTFPCDFAWGVVDNCIQVDTTLSQFIDPNVYLWDVHRSKRLIKVDGVLTKTRKSYCVDFAAIRPQIALLQEMHVTHFHFSLDWALILPLGNRSQVNRTVLGFYRCVASELVRANITPVVALWRPAAPHQGLPAPLARHGAWENPHTALAFAEYASLCFQDLGRHVKFWITMHEPSTRNMTYSAGHNLLKAHALAWRTYDERFRRSQKGKISIALQADWIEPACPFSPEDREVAERVLEFDIGWLAEPIFGSGDYPRVMREWLNQRNNFLLPYFTDEEKKLIRGSFDFLALSHYTTILVDWEKEDPIKYNDYLAVQEMTDITWLNSPSQVAVVPWGLRKVLNWLKAKYGDLPMYIISNGIDDDPHTAQDNLRVYYMQNYVNEALKAYILDGINLCGYFAYSFNDRTAPKFGLYRYAANQFEPKPSMKHYRKIIDNNGFPGPETLGRFCPEEFTLCTECSFFHARKSLLAFIAFLLFAFVISLSLIFYYSKKGRRGYK

SEQ ID NO: 121 - protein, 4570 aa, Canis familiaris
ATGGCCACCTGCATTTTACAGATGAGATTCCTAAGGCTGGGGAAGATACTGTTCCACTCCAGCCCACAAAGCACAGGTGGCAGTGGTGGGACCCGGGGACCTCGAGCTCCGGCACAGCTGCGAACGCAGCGTGGCACAGATAAGTTAGTTGCTAAGTCAGAGCTCAAGGCTAAAACGGCCCACCGCGCGCTGGCCGACCACTTCAGGGACTACGCCGAGCTCTGCTTCCGCCACTTCTGCGGCCAGGTCAAGTACTGGATCACCATCGACAACCCCTACGTGGTGGCCTGGCACGGCTACGCCACCGGGCGCCTGGCCCCCGGCGTCCGGGGCAGCCCGCGGCTCGGGTACCTGGTGGCGCACAACCTCCTCCTGGCTCACGCCAAAATCTGGCATCTCTACAATACTTCTTTCCGCCCAACTCAGGGAGGCCAGGTATCCATTGCCCTAAGCTCCCACTGGATCAATCCTCGAAGAATGACCGACCATAGCATCAAAGAATGTCAAAAATCTCTTGACTTTGTACTAGGCTGGTTTGCCAAGCCCATATTTATTGATGGTGACTATCCTGAGAGCATGAAGAATAACCTGTCATCTCTTCTGCCTGTTTTTACTGAATCTGAGAAAAAGTTCATCAAGGGAACAGCTGACTTTTTTGCTCTTTCTTTTGGACCAACTTTGAGTTTTCAACTCTTGGACCCTCATATGAAGTTCCACCAATTAGAATCTCCCAGCCTGAGGCAACTCCTTTCTTGGATTGACCTTGAATATAACCACCCTCAAATATTTATTGTGGAAAATGGCTGGTTTGTCTCAGGGACCACCAAGAGAGATGATGCCAAATATATGTATTACCTCAAAAAATTCATAATGGAAACCTTAAAAGCCATCAGGCTGGATGGGGTGGATGTCATAGGATACACAGCGTGGTCCCTTATGGATGGCTTCGAGTGGCACAGAGGCTACAGCATCAGACGTGGACTCTTCTACGTGGACTTTCTAAGCCAGGATAAGAAACTGTTGCCAAAGTCTTCAGCCTTGTTCTACCAAAAGCTGATAGAGAAAAATGGCTTCCCTCCTTTACCTGAAAATCAGCCCCTAGAAGGGACATTTCCCTGTGACTTTGCTTGGGGAATTGTTGACAACTACATTCAAGTGGACACCACTCTGTCTCAGTTTACCGACCCGAACGTTTACCTGTGGGACGTCCATCACAGCAAGAGGCTGATTAAGGTGGACGGGCTGCGGGCCAAGAAGAGGAAGCCCTACTGCGTGGACTTTGCCGCCATCGGGCCCCAGGTGGCCCTGCTGCAGGAGATGCACGTCTCGCATTTTCACTTCTCGCTGGACTGGGCCCTGCTCCTGCCGCTGGGCAACCAGTCCCGGGTGAACCACGCGGCCCTGCACTACTACGGCTGCGTGGCCAGCGAGCTCCTGCGCGCCAACATCACCCCGGTGGTGGCGCTCTGGCGCCCCGCCGCCGCGCACCAGGGCCTGCCGGGGCCGCTGGCCCAGCGCGGCGCCTGGGAGAACCCGCGCACCGCCCTGGCGTTCGCCGAGTACGCGCGCCTGTGCTTCCGCGCCCTGGGCCGCCACGTCAAGGTGTGGATCACGCTGCGCGAGCCGCCCACGCGGAACCTGACGCTCCGCGCCGGGCACAACCTGCTGCGGGCGCACGCGCTGGCCTGGCGCGTGTACGACGAGCAGTTCCGGGGCTCGCAGCAGGGGAAGGTGTCCATCGCCCTGCAGGCCGACTGGGTGGAGCCCGCCTGCCCCTCCTCCCAGAAGGACCGCGAAGTGGCCGAGAGGGTTCTGGAGTTCGACGTCGGCTGGCTGGCCGAGCCCATCTTCGGCTCCGGGGACTACCCGCGGCTGATGCGCGACTGGCTCACCCGGAGAGACCATTCCCTCCTGCCCTATTTCACTGACGAAGAGAAGAGGCTAATCCGGGGTTCCTTTGACTTCCTGGCCTTGAGCCATTACACCACCATCCTCGTGGACTGGGAAAAGGAAGACCCAGTCAAATACAATGATTACCTGGAAGTGCAGGAGATGACCGACATCACCTGGCTCAACTCCCCCAGTCAGGTGGCCGTAGTGCCCTGGGGCCTGCGCAAAGTGCTCAACTGGCTCAAGTTCAAGTACGGAGACCTCCCCATGTATATCGTATCCAACGGCATAGATGACGATCCGCGGGCAGCCCAGGACTCGTTGAGGGTGTATTACATGCAGAACTATGTAAATGAAGCTCTGAAAGCCTACGTATTGGATGGTATCAATCTTTGTGGATACTTTGCCTACTCATTTAATGATCGCACAGCTCCGAAGTTTGGCCTCTATCATTATGCTGCAAACCAGTTTGAGCCCAAACCGTCGGTGAAGCATTACAGGAAAATTATTGACAACAATGGCTTCCCAGGCCCTGAAACTTTGGGGCGGTTTTGTCCAGAGGAATTCACCCTGTGCACCGAATGCAGCTTTTTTCACACCCGAAAGTCTTTACTGGCTTTCATAGCTTTCCTACTTTTTGCTTTTATTATTTCTCTTTCTCTGATTTTCTACTACTCTAGGAAAGGCAGAAGAAGTTATAAATAGTCCTGAACATTTTCCTATTCATCTATTTTGAAATAATTATGCACATACATCAGCTGTTAACCATTTGCACTTCTCAGTGTTGTGAAACTATAGGTTTCGTTATTCCGGCTTCTAGAAGAAAAATTTTTGTGGCATATGACAGACGTTTGTAAATGAGCATAGCTGATTGTAAAATATTGGATAATGTGAATAGTGCCTGGATTTGTTCTTTTTTTGAAGGGTAATCAAAGACTGTCAGGGGCCATCATTCCTGTAACACACACTGTAACAAATGTATGGGAAGTGGGGGTCACTCTGCAACATTTTTACAGAAATTGAATGGTGCCCATTCAATTAGTGCCCATTCTTAAATGTAATGTTTATCTCGAAGTAATAATTGCAGATGTTGGAATAAAAAGTTAAAAGGTCCCAAGCAACCATCTCTAAACCGCCATGATATGCCTAAGGGTTCGCTGTTGAACCAAGTTTCCCCTGAAAAACAAAGGGGTAGAATATAGGAGAAGTGACAAGGGGCCAAGGGGGGCAGCAACGTTCCTTTTAAAAGCAGTGTTTCTAGCAAATGCTGCTAATATTAGTTTCCGTGTCTGGTTAATGATATGTTTAGCAGAGCAGATTATAGAACTTCATCGTTTGTGACTTTTGAGGTCTCCAGGCCCGGGGGTCCTTGAGGACTTTGTGTTACTGGGGCCTTACCAAGGGCCTGCGCAAAAAGGACTCTTAATGTTTGTAGAAAAATAAGTATGAATCGTGAGATGTTGGCCTCTTCAGGAAGCATGAACTGATCTTGAAATGCATTGTACTGCGTGGCTCTAGGGGGAGGAAAGGAGGAAAAAGTACTTATTATGAGCAACGGTATGATTAATTTGATTATAAACTCTTCGATTTTAGAGCACTCCATGCAATGAATGATGTGACCTTTCCTGAGCAAGTGAGAACGAAATAATAACTCATCCGCTGACGAGTGACTTCGCTTGCTGTTCTTCAGAATGTGTCATGATTTCTTTGAATTGAGGTTTTTAAAATTCTTAGTAGGCTCCAAAGCATTTGGTCTGATAACACTGGGAGATTTGTTCCTATGATTGCTGAGGTTTATTTTACATTGTTGCTGCAACTTCTGTGGAACTAGCTTTGAACTAGTTTTGCTTTGAACTTTCACAGTGAAACAGGCTACTGATTTCTAGAAAGGGCTAATGAGGTCTTATCCTTGAAAGCCCCTTAAGTTTTGATGATTTTCAGACAGGGGTCTTTCTGTTACACTGGAGTTGCGGATGATCATGTTATTTCTTTTCTAGATAAGCCAATATCATATCAGGCAAGGTAAACCACTATCATATCTAGCATCGCTAATCTTGCTGACACAGGGTGATAGTGTGCAAAAAAATTGCTGTACTGTATTATGTATCATCTTCAGAGGTGGTAGGATTTTTTTTCCATGAAAGATGAGCTTTTGTTGGTAATCTTTTAAAAATTGGACTTGGTATTAAAATTAGAAACTAGATATAATAGTTTCTTTTATGTATATATTTTTTCCGATTCTTAGAGTAATTTATGTTCATTGTAAAAAATTGAAAAACACAGAAACTATATGTAAAGAGAAAAATGACCTATAAGCTCACTACCAAAGTGGCCACTATTAACATAGCCGATGTATTTTATTTTGCATGGAGTCAGATCATATTGCAAATAATTATGTGTCTTTATTAATTTCTATCGTGTGTGTTTCTTTTGTCATTAGTCTTCAAAAGCATGATTTCTAATAGTTGTAGAGTGATTCTGCTTTATGAATTTATCACAACTCATGTAACCATTCCTATTGGTTGGACCAGTTTATTGTTAATTACTGTTAAATAATGTTTAAAAATATTCTTGCTACAACATTAATTTTCATTTCCTTGAGTGTAGACAGAAGTAATTCTGTCCCTTGATGAAGTATTGTAATAAATCTGCCTGAGGCTTTGCTTCTTTCCTAATTATA

SEQ ID NO: 122 - protein, 2805 aa, Felis catus
CATGGTGATTAGTGGACTAGGCTCATGCCAAAATCTGGCATCTCTACAATACTTCTTTCCGTCCAACTCAGGGAGGCCAGGTCTCCATCGCCCTAAGCTCCCACTGGATCAATCCTCGAAGAATGACCGACCACAGCATCAAAGAATGTCAAAAGTCTCTTGACTTTGTACTAGGCTGGTTTGCCAAACCCATATTTATTGATGGTGACTATCCTGAGAGCATGAAGAATAATCTTTCACATCTTCTGCCTGATTTTACTGAAGCTGAGAAAAAGTTCATTAAGGGAACAGCTGACTTTTTTGCTCTTTCTTTTGGACCAACCTTGAGTTTTCAACTATTGGACCCCCACATGAAGTTCCGCCAGTTAGAATCTCCCAGCCTGAGGCAACTCCTTTCTTGGATTGACCTTGAATATAACCACCCTCAAATATTTATTGTGGAAAATGGCTGGTTTGTCTCAGGGACCACCAAGAGAGACGACGCCAAATATATGTATTACCTCAAAAAATTCGTAATGGAAACCTTAAAAGCCATTAGGCTGGATGGGGTGGACGTCATTGGGTACACGGCCTGGTCCCTTATGGATGGCTTCGAATGGCACAGAGGTTACAGCATCAGGCGTGGACTCTTCTATGTTGACTTTCTAAGCCAGGATAAGAAACTGTTGCCGAAATCTTCAGCCTTGTTCTACCAAAAGCTGATAGAGAAAAATGGCTTCCCTCCTTTACCTGAAAATCAACCTCTAGAAGGGACATTTCCCTGTGACTTTGCTTGGGGAATTGTTGACAACTACATTCAAGTGGACACCACTCTGTCTCAGTTTACCGACCCGAACGTTTACCTGTGGGACGTCCACCACAGTAAGAGGCTAATTAAGGTGGACGGGGTTGTGACCAAGAAGCGGAAGTCCTACTGCGTGGACTTCGCTGCCATCCGGCCCCAGATAGCCTTACTCCAGGAGATGCACGTTTCCCATTTCCACTTCTCCCTGGACTGGGCCCTGATCCTGCCGCTGGGCAACCAGTCCCAGGTGAACCACACGGTCCTCGACTACTACCGCTGCGTGGTCAGCGAGCTCGTGCGCGCCAACATCACCCCGGTGGTGGCGCTCTGGCGACCCGCGGCCCCGCACCAAGGGCTGCCGCGGCCCCTGGCCAAGCACGGAGCCTGGGAGAACCCACACACCGCCTCGGCTTTTGCAGAGTACGCCCGGCTGTGCTTCAAGGATCTCGGCCACCACGTCAAGTTCTGGATCACGATGGGCGAGCCGTACACACGGAACATGACCTACAGCGCGGGGCACAATCTTCTGAAGGCTCACGCGTTGGCCTGGCGCGTGTACGATGAAAACTTTCGGGGCTCTCAGAAGGGGAAAATATCCATAGCCCTGCAGGCCGACTGGATAGAGCCGGCCTGCCCTTTCTCCCAAAAGGACAAAGAAGTGGCAGAGAGAGTTTTGGAATTTGACATTGGCTGGCTGGCCGAGCCCATTTTCGGCTCTGGGGATTATCCGCGTGTGATGAGGGACTGGCTCACGCAGAGAAACAATTTCCTTCTACCTTATTTCACTGAAGATGAAAAAAAGCTAATCCGGGGTTCCTTCGACTTTCTGGCCGTAAGCCATTACACCACCATCCTCGTCGACTGGGAAAAAGAAGATCCAATGAAATACAACGATTACCTGGAGGTGCAGGAAATGACCGACATCACGTGGCTCAACTCCCCCAGTCAGGTGGCAGTAGTGCCCTGGGGCTTACGCAAAATTCTCAACTGGCTGAAGCTGAAGTACGGAGACCTCCCCATGTATATAATATCCAACGGCATAGACGACGATCCGCAGGCAGCGCAAGACAAGCTGAGGGTGTATTACATGCAAAATTATGTAAATGAAGCTCTGAAAGCCTACGTATTGGATGGTGTCAATCTTTGTGGATACTTTGCTTATTCATTCAATGATCGCACAGCTCCAAAGTTTGGCTTCTATCATTACGCTGCAAATCAGTTTGAGCCCAAACCGTCCATGAAACATTATCGGAAAATGATTGACAGCAATGGCTTCTCCGGTCCTGACACTCTGGGGAGATTTTGTCCAGAAGAATTCACCCTGTGCACCGAATGCGGCTTTTTTCACACCCGCAAATCTTTACTGGCTTTCATAGCTTTCCTACTTTTTGCTTTTATTATTTCTCTTTCTCTGATTTTTTACTACTCTAAGAAAGGCAAAAGAAGTTACAAGTAGTCCTGACCTTTTTCCTATTCATTTACTTTGAAATGATTATGCACACACATCAGCTGTTCACCATTTGCACTTCTCAGTGTCGTAAGACTGGATTTCACTTATCTGACTTCTAGAAAAAAAATGTGTGGCGTATGACAGAGGTATGGAAGTGAGCATAGGTGATTGTAAAATACTGAATAATGTGAATAGTGCCTGGATTTGTTCTTTCTTGGAGGATGATCAAAGACGGTTAGGGGCCATCATCTCTGCAACACATTCTGTAACAAATGTATGGGAAGTGGGACCCATTCTGGAACATTTTTATAGAAATTGAATAGCAAGATCAGTGCCCGTTCCTAAATTATCTTGAAGTAAAACAAATGTGGAAATAAAAAGTTAAGTCCCAAATAACCATCTCTAAACTTCCATGATATGCCTAATGGTCTCTGTTGGACCCAGTTTCCCTTGAAAAAGAAATGGTAGAATATTAGAGACATGACAGAGGGCCCTACGCTAGAACGTTCCTTTTATTTTTTTTTTTAAATTTTTTTTCAATGTTTTTATTTATTTTTGGGACAGAGAGAGA

SEQ ID NO: 123 - protein, 3178 aa, Felis catus
GGGGTCACCCACTACCGCTTCTCCATCTCGTGGGCGCGGGTGCTCCCCAATGGCAGCGCGGGCGCCCCCAACCGCGAGGGGCTGCGCTACTACCGGCGCCTGCTGGAGCGGCTGCGGGAGCTGGGCGTGCAGCCCGTGGTCACCCTGTACCACTAGGACCTGCCCCAGCGCCTGCAGGACGCCTACGGCGGCTGGGCCAACCGCGCCCTGGCCGACCACTTCAGGGATTACGCCGAGCTCTGCTTCCGCCACTTCGGCGGCCAGGTCAAGTACTGGATCACCATCGACAACCCCTACGTGGTGGCCTGGCACGGCTACGCCACCGGGCGCCTGGCCCCTGGCGTCCGGGGCAGCGCGCGGCTCGGGTACCTGGTGGCGCACAACCTCCTCCTGGCTCATGCCAAAATCTGGCATCTCTACAATACTTCTTTCCGTCCAACTCAGGGAGGCCAGGTCTCCATCGCCCTAAGCTCCCACTGGATCAATCCTCGAAGAATGACCGACCACAGCATCAAAGAATGTCAAAAGTCTCTTGACTTTGTACTAGGCTGGTTTGCCAAACCCATATTTATTGATGGTGACTATCCTGAGAGCATGAAGAATAATCTTTCACATCTTCTGCCTGATTTTACTGAAGCTGAGAAAAAGTTCATTAAGGGAACAGCTGACTTTTTTGCTCTTTCTTTTGGACCAACCTTGAGTTTTCAACTATTGGACCCCCACATGAAGTTCCGCCAGTTAGAATCTCCCAGCCTGAGGCAACTCCTTTCTTGGATTGACCTTGAATATAACCACCCTCAAATATTTATTGTGGAAAATGGCTGGTTTGTCTCAGGGACCACCAAGAGAGACGACGCCAAATATATGTATTACCTCAAAAAATTCGTAATGGAAACCTTAAAAGCCATTAGGCTGGATGGGGTGGACGTCATTGGGTACACGGCCTGGTCCCTTATGGATGGCTTCGAATGGCACAGAGGTTACAGCATCAGGCGTGGACTCTTCTATGTTGACTTTCTAAGCCAGGATAAGAAACTGTTGCCGAAATCTTCAGCCTTGTTCTACCAAAAGCTGATAGAGAAAAATGGCTTCCCTCCTTTACCTGAAAATCAACCTCTAGAAGGGACATTTCCCTGTGACTTTGCTTGGGGAATTGTTGACAACTACATTCAAGTGGACACCACTCTGTCTCAGTTTACCGACCCGAACGTTTACCTGTGGGACGTCCACCACAGTAAGAGGCTAATTAAGGTGGACGGGGTTGTGACCAAGAAGCGGAAGTCCTACTGCGTGGACTTCGCTGCCATCCGGCCCCAGATAGCCTTACTCCAGGAGATGCACGTTTCCCATTTCCACTTCTCCCTGGACTGGGCCCTGATCCTGCCGCTGGGCAACCAGTCCCAGGTGAACCACACGGTCCTCGACTACTACCGCTGCGTGGTCAGCGAGCTCGTGCGCGCCAACATCACCCCGGTGGTGGCGCTCTGGCGACCCGCGGCCCCGCACCAAGGGCTGCCGCGGCCCCTGGCCAAGCACGGAGCCTGGGAGAACCCACACACCGCCTCGGCTTTTGCAGAGTACGCCCGGCTGTGCTTCAAGGATCTCGGCCACCACGTCAAGTTCTGGATCACGATGGGCGAGCCGTACACACGGAACATGACCTACAGCGCGGGGCACAATCTTCTGAAGGCTCACGCGTTGGCCTGGCGCGTGTACGATGAAAACTTTCGGGGCTCTCAGAAGGGGAAAATATCCATAGCCCTGCAGGCCGACTGGATAGAGCCGGCCTGCCCTTTCTCCCAAAAGGACAAAGAAGTGGCAGAGAGAGTTTTGGAATTTGACATTGGCTGGCTGGCCGAGCCCATTTTCGGCTCTGGGGATTATCCGCGTGTGATGAGGGACTGGCTCACGCAGAGAAACAATTTCCTTCTACCTTATTTCACTGAAGATGAAAAAAAGCTAATCCGGGGTTCCTTCGACTTTCTGGCCGTAAGCCATTACACCACCATCCTCGTCGACTGGGAAAAAGAAGATCCAATGAAATACAACGATTACCTGGAGGTGCAGGAAATGACCGACATCACGTGGCTCAACTCCCCCAGTCAGGTGGCAGTAGTGCCCTGGGGCTTACGCAAAATTCTCAACTGGCTGAAGCTGAAGTACGGAGACCTCCCCATGTATATAATATCCAACGGCATAGACGACGATCCGCAGGCAGCGCAAGACAAGCTGAGGGTGTATTACATGCAAAATTATGTAAATGAAGCTCTGAAAGCCTACGTATTGGATGGTGTCAATCTTTGTGGATACTTTGCTTATTCATTCAATGATCGCACAGCTCCAAAGTTTGGCTTCTATCATTACGCTGCAAATCAGTTTGAGCCCAAACCGTCCATGAAACATTATCGGAAAATGATTGACAGCAATGGCTTCTCCGGTCCTGACACTCTGGGGAGATTTTGTCCAGAAGAATTCACCCTGTGCACCGAATGCGGCTTTTTTCACACCCGCAAATCTTTACTGGCTTTCATAGCTTTCCTACTTTTTGCTTTTATTATTTCTCTTTCTCTGATTTTTTACTACTCTAAGAAAGGCAAAAGAAGTTACAAGTAGTCCTGACCTTTTTCCTATTCATTTACTTTGAAATGATTATGCACACACATCAGCTGTTCACCATTTGCACTTCTCAGTGTCGTAAGACTGGATTTCACTTATCTGACTTCTAGAAAAAAAATGTGTGGCGTATGACAGAGGTATGGAAGTGAGCATAGGTGATTGTAAAATACTGAATAATGTGAATAGTGCCTGGATTTGTTCTTTCTTGGAGGATGATCAAAGACGGTTAGGGGCCATCATCTCTGCAACACATTCTGTAACAAATGTATGGGAAGTGGGACCCATTCTGGAACATTTTTATAGAAATTGAATAGCAAGATCAGTGCCCGTTCCTAAATTATCTTGAAGTAAAACAAATGTGGAAATAAAAAGTTAAGTCCCAAATAACCATCTCTAAACTTCCATGATATGCCTAATGGTCTCTGTTGGACCCAGTTTCCCTTGAAAAAGAAATGGTAGAATATTAGAGACATGACAGAGGGCCCTACGCTAGAACGTTCCTTTTATTTTTTTTTTTAAATTTTTTTTCAATGTTTTTATTTATTTTTGGGACAGAGAGAGA

SEQ ID NO: 124 - protein, 2968 aa, Felis catus
TCTTTCTGGATTGCTCCGTCATGAGAACCGGTGTCAGCACGTGGGCTGGTTTACTGAAAGGTGAAGACAGACTTTGGAAGATCAAAGATCACCCTGGATGTTCTCGCCACCGGTGAGATCCCAGCTGAGTGCAGCTATATGCGTGACCTCTGCTACATCACATGGAGCAGAGGAACTGTCCAGGCTCATGCCAAAATCTGGCATCTCTACAATACTTCTTTCCGTCCAACTCAGGGAGGCCAGGTCTCCATCGCCCTAAGCTCCCACTGGATCAATCCTCGAAGAATGACCGACCACAGCATCAAAGAATGTCAAAAGTCTCTTGACTTTGTACTAGGCTGGTTTGCCAAACCCATATTTATTGATGGTGACTATCCTGAGAGCATGAAGAATAATCTTTCACATCTTCTGCCTGATTTTACTGAAGCTGAGAAAAAGTTCATTAAGGGAACAGCTGACTTTTTTGCTCTTTCTTTTGGACCAACCTTGAGTTTTCAACTATTGGACCCCCACATGAAGTTCCGCCAGTTAGAATCTCCCAGCCTGAGGCAACTCCTTTCTTGGATTGACCTTGAATATAACCACCCTCAAATATTTATTGTGGAAAATGGCTGGTTTGTCTCAGGGACCACCAAGAGAGACGACGCCAAATATATGTATTACCTCAAAAAATTCGTAATGGAAACCTTAAAAGCCATTAGGCTGGATGGGGTGGACGTCATTGGGTACACGGCCTGGTCCCTTATGGATGGCTTCGAATGGCACAGAGGTTACAGCATCAGGCGTGGACTCTTCTATGTTGACTTTCTAAGCCAGGATAAGAAACTGTTGCCGAAATCTTCAGCCTTGTTCTACCAAAAGCTGATAGAGAAAAATGGCTTCCCTCCTTTACCTGAAAATCAACCTCTAGAAGGGACATTTCCCTGTGACTTTGCTTGGGGAATTGTTGACAACTACATTCAAGTGGACACCACTCTGTCTCAGTTTACCGACCCGAACGTTTACCTGTGGGACGTCCACCACAGTAAGAGGCTAATTAAGGTGGACGGGGTTGTGACCAAGAAGCGGAAGTCCTACTGCGTGGACTTCGCTGCCATCCGGCCCCAGATAGCCTTACTCCAGGAGATGCACGTTTCCCATTTCCACTTCTCCCTGGACTGGGCCCTGATCCTGCCGCTGGGCAACCAGTCCCAGGTGAACCACACGGTCCTCGACTACTACCGCTGCGTGGTCAGCGAGCTCGTGCGCGCCAACATCACCCCGGTGGTGGCGCTCTGGCGACCCGCGGCCCCGCACCAAGGGCTGCCGCGGCCCCTGGCCAAGCACGGAGCCTGGGAGAACCCACACACCGCCTCGGCTTTTGCAGAGTACGCCCGGCTGTGCTTCAAGGATCTCGGCCACCACGTCAAGTTCTGGATCACGATGGGCGAGCCGTACACACGGAACATGACCTACAGCGCGGGGCACAATCTTCTGAAGGCTCACGCGTTGGCCTGGCGCGTGTACGATGAAAACTTTCGGGGCTCTCAGAAGGGGAAAATATCCATAGCCCTGCAGGCCGACTGGATAGAGCCGGCCTGCCCTTTCTCCCAAAAGGACAAAGAAGTGGCAGAGAGAGTTTTGGAATTTGACATTGGCTGGCTGGCCGAGCCCATTTTCGGCTCTGGGGATTATCCGCGTGTGATGAGGGACTGGCTCACGCAGAGAAACAATTTCCTTCTACCTTATTTCACTGAAGATGAAAAAAAGCTAATCCGGGGTTCCTTCGACTTTCTGGCCGTAAGCCATTACACCACCATCCTCGTCGACTGGGAAAAAGAAGATCCAATGAAATACAACGATTACCTGGAGGTGCAGGAAATGACCGACATCACGTGGCTCAACTCCCCCAGTCAGGTGGCAGTAGTGCCCTGGGGCTTACGCAAAATTCTCAACTGGCTGAAGCTGAAGTACGGAGACCTCCCCATGTATATAATATCCAACGGCATAGACGACGATCCGCAGGCAGCGCAAGACAAGCTGAGGGTGTATTACATGCAAAATTATGTAAATGAAGCTCTGAAAGCCTACGTATTGGATGGTGTCAATCTTTGTGGATACTTTGCTTATTCATTCAATGATCGCACAGCTCCAAAGTTTGGCTTCTATCATTACGCTGCAAATCAGTTTGAGCCCAAACCGTCCATGAAACATTATCGGAAAATGATTGACAGCAATGGCTTCTCCGGTCCTGACACTCTGGGGAGATTTTGTCCAGAAGAATTCACCCTGTGCACCGAATGCGGCTTTTTTCACACCCGCAAATCTTTACTGGCTTTCATAGCTTTCCTACTTTTTGCTTTTATTATTTCTCTTTCTCTGATTTTTTACTACTCTAAGAAAGGCAAAAGAAGTTACAAGTAGTCCTGACCTTTTTCCTATTCATTTACTTTGAAATGATTATGCACACACATCAGCTGTTCACCATTTGCACTTCTCAGTGTCGTAAGACTGGATTTCACTTATCTGACTTCTAGAAAAAAAATGTGTGGCGTATGACAGAGGTATGGAAGTGAGCATAGGTGATTGTAAAATACTGAATAATGTGAATAGTGCCTGGATTTGTTCTTTCTTGGAGGATGATCAAAGACGGTTAGGGGCCATCATCTCTGCAACACATTCTGTAACAAATGTATGGGAAGTGGGACCCATTCTGGAACATTTTTATAGAAATTGAATAGCAAGATCAGTGCCCGTTCCTAAATTATCTTGAAGTAAAACAAATGTGGAAATAAAAAGTTAAGTCCCAAATAACCATCTCTAAACTTCCATGATATGCCTAATGGTCTCTGTTGGACCCAGTTTCCCTTGAAAAAGAAATGGTAGAATATTAGAGACATGACAGAGGGCCCTACGCTAGAACGTTCCTTTTATTTTTTTTTTTAAATTTTTTTTCAATGTTTTTATTTATTTTTGGGACAGAGAGAGA

We claim:

1. A method of treating and/or preventing acute kidney injury or chronic kidney disease in a mammalian subject, the method comprising:
   administering to the mammalian subject a pharmaceutical composition comprising:
      a pharmaceutically acceptable carrier or excipient; and
      an effective amount of a recombinant fusion protein comprising:
         a Klotho protein sequence having 100% amino acid sequence identity to SEQ ID NO: 109; and
         an immunoglobulin Fc domain having at least 99% amino acid sequence identity to SEQ ID NO: 74; and
         optionally, a linker disposed between the Klotho protein sequence and the immunoglobulin Fc domain.

2. The method of claim 1, wherein the acute kidney injury is selected from the group consisting of:
   (i) surgery- or medical procedure-induced kidney damage, kidney surgery-induced kidney damage, or kidney transplant-induced kidney damage;
   (ii) sepsis-induced kidney damage;

(iii) renal ischemia, surgery- or medical procedure-induced renal ischemia, kidney surgery-induced renal ischemia, kidney transplant-induced renal ischemia, cardio-vascular surgery-induced renal ischemia, aorta repair surgery-induced renal ischemia, aneurism repair surgery-induced renal ischemia, heart surgery-induced renal ischemia, heart bypass surgery-induced renal ischemia, coronary artery bypass surgery-induced renal ischemia, and/or cardiopulmonary bypass surgery-induced renal ischemia; and (iv) nephrotoxicity, drug-induced nephrotoxicity, anti-microbial-induced nephrotoxicity, or aminoglycoside-induced nephrotoxicity.

3. The method of one of claim 1, further comprising:
measuring a concentration of soluble Klotho protein in a bodily fluid of the subject; and
calculating a first dosage of the pharmaceutical composition sufficient to raise the concentration of soluble Klotho protein at least to a predetermined level and/or for a predetermined period of time, the administered composition comprising the first dosage.

4. The method of claim 3, further comprising:
measuring a rate of soluble Klotho protein concentration decline in a bodily fluid of the subject following the administering step;
calculating a time and/or amount of a subsequent dosage of the composition; and
administering the subsequent dosage of the pharmaceutical composition to the subject in accordance with the calculated time and/or amount.

5. The method of claim 3, wherein the predetermined level is:
greater than or equal to about 50 picograms of soluble Klotho protein per milliliter of the bodily fluid;
between 0.0001-10 mg/kg body weight of the subject; and/or
greater than or equal to about 5% greater than a known, typical, healthy level of soluble Klotho protein in the bodily fluid of the subject.

6. The method of claim 3, wherein the predetermined period of time is greater than or equal to about 6 hours.

7. The method of claim 1, wherein each administering step is sufficient to raise and/or maintain a concentration of soluble Klotho protein in a bodily fluid of the subject at least to a predetermined level and/or for a predetermined period of time.

8. The method of claim 1, wherein the protein is administered:
prophylactically, prior to one or more of kidney surgery, kidney transplant, cardio-vascular surgery, heart bypass surgery, coronary artery bypass surgery, cardiopulmonary bypass surgery, and administration of a nephrotoxin; and/or
following one or more of kidney surgery, kidney transplant, cardio-vascular surgery, heart bypass surgery, coronary artery bypass surgery, cardiopulmonary bypass surgery, and administration of a nephrotoxin.

9. The method of claim 8, wherein the nephrotoxin is selected from the group consisting of:
one or more aminoglycosides, optionally selected from the group consisting of paromomycin, tobramycin, gentamicin, amikacin, kanamycin, and neomycin;
one or more non-steroid anti-inflammatory drugs (NSAIDs), optionally selected from the group consisting of aspirin (acetylsalicylic acid), celecoxib, diclofenac, diflunisal, etodolac, ibuprofen, indomethacin, ketoprofen, ketorolac, nabumetone, naproxen, oxaprozin, piroxicam, salsalate, sulindac, and tolmetin;
one or more anti-microbial agents, optionally selected from the group consisting of penicillin, ampicillin, a cephalosporin, a sulfonamide, ciprofloxacin, vancomycin, a macrolide, a tetracycline, and rifampin;
one or more anti-fungal agents, optionally selected from the group consisting of amphotericin B and flucytosine;
one or more contrast agents, optionally selected from the group consisting of iodinated radiocontrast media, high-osmolality contrast media (HOCM) having an iodine to molecule ratio of about 1.5:1, low-osmolality, nonionic contrast media (LOCM) having an iodine to molecule ratio of about 3:1, and iso-osmolar contrast media (IOCM) having an iodine to molecule ratio of about 6:1;
one or more antiretroviral agents, optionally selected from the group consisting of adefovir, cidofovir, tenofovir, and foscarnet;
one or more cancer therapeutics or chemotherapeutics, optionally selected from the group consisting of cisplatin, carboplatin, oxaliplatin, an alkylating agent, bendamustine, cyclophosphamide, ifosfamide, a nitrosourea, temozolomide, melphalan, an antitumor antibiotic, mitomycin C, bleomycin, an anthracycline, an antimetabolite, capecitabine, hydroxyurea, methotrexate, pemetrexed, pralatrexate, pentostatin, fludarabine, cladribine, gemcitabine, cytarabine, *vinca* alkaloids, topotecan, etoposide, a taxane, irinotecan, lenalidomide, eribulin, arsenic trioxide, and ixazomib;
one or more bisphosphonates, or derivatives thereof, optionally selected from the group consisting of zoledronate/zoledronic acid, ibandronate, alendronate, alendronate/cholecalciferol, etidronate, risedronate, risedronate calcium carbonate, pamidronate, and tiludronate;
one or more cyclooxygenase-2 (COX-2) inhibitors, optionally selected from the group consisting of valdecoxib, rofecoxib, and celecoxib;
one or more proton pump inhibitors, optionally selected from the group consisting of omeprazole and lansoprazole;
one or more anticonvulsants, optionally selected from the group consisting of phenytoin and valproic acid;
one or more histamine H2 receptor antagonists, optionally selected from the group consisting of nizatidine, ranitidine, famotidine, and cimetidine;
one or more diuretics, optionally selected from the group consisting of pamabrom, mannitol, a carbonic anhydrase inhibitor, a loop diuretic, bumetanide, ethacrynic acid, torsemide, furosemide, a potassium-sparing diuretic, triamterene, spironolactone, amiloride, a thiazide diuretic, indapamide, chlorthalidone, metolazone, methyclothiazide, hydrochlorothiazide, chlorothiazide, bendroflumethiazide, polythiazide, and hydroflumethiazide;
one or more narcotics or opioids, optionally selected from the group consisting of cocaine and heroin;
one or more elements or elemental metals, optionally selected from the group consisting of lithium, gold, copper, and mercury;
one or more direct-acting smooth muscle relaxants or hydralazine;
one or more spasmolytics, optionally selected from the group consisting of carisoprodol, cyclobenzaprine, metaxalone, methocarbamol, diazepam, clonidine, tizanidine, baclofen, dantrolene, an imidazoline compound, a benzodiazepine, and a hydantoin derivative; and one or more heavy metal toxicity drugs, immunosuppressants, chelating drugs, or (D-) penicillamine.

10. The method of claim 1, wherein the immunoglobulin Fc domain has 100% amino acid sequence identity to SEQ ID NO: 74.

11. The method of claim 1, wherein one or more of:
at least some of the recombinant fusion protein is in a coated, encapsulated, controlled-release, extended-release, delayed-release, or sustained-release formulation; and
the composition further comprises one or more components selected from the group consisting of aggregation inhibitors, buffers, tonicity modifiers, and additional excipients.

12. The method of claim 1, wherein the recombinant fusion protein further comprises a synthetic signal sequence having at least 90% amino acid sequence identity to SEQ ID NO: 72.

13. The method of claim 1, wherein the recombinant fusion protein further comprises the linker A method of treating and/or preventing acute kidney injury or chronic kidney disease in a mammalian subject, the method comprising:
administering to the mammalian subject a pharmaceutical composition comprising:
a pharmaceutically acceptable carrier or excipient; and
an effective amount of a recombinant fusion protein comprising:
a Klotho protein sequence having at least 99% amino acid sequence identity to SEQ ID NO: 109; and
an immunoglobulin Fc domain having at least 99% amino acid sequence identity to SEQ ID NO: 74; and
a linker disposed between the Klotho protein sequence and the immunoglobulin Fc domain, the linker having at least 88% amino acid sequence identity to SEQ ID NO: 73.

14. The method of claim 13, wherein the Klotho protein sequence comprises, relative to SEQ ID NO: 1, phenylalanine at residue 45 or valine at residue 45.

15. The method of claim 13, wherein the Klotho protein sequence comprises, relative to SEQ ID NO: 1, histidine at residue 193 or other than arginine at residue 193.

16. The method of claim 13, wherein the Klotho protein sequence comprises, relative to SEQ ID NO: 1, phenylalanine at residue 352 or other than valine at residue 352.

17. The method of claim 13, wherein the Klotho protein sequence comprises, relative to SEQ ID NO: 1, cysteine at residue 370 or serine at residue 370.

18. The method of claim 13 further comprising:
measuring a concentration of soluble Klotho protein in a bodily fluid of the subject;
calculating a first dosage of the pharmaceutical composition sufficient to raise the concentration of soluble Klotho protein in the bodily fluid of the subject above a predetermined level and to maintain the concentration of soluble Klotho protein in the bodily fluid of the subject above the predetermined level for a predetermined period of time,
wherein administering the pharmaceutical composition comprises administering the first dosage of the pharmaceutical composition to the subject, wherein the step of administering the first dosage is sufficient to raise the concentration of soluble Klotho protein in the bodily fluid of the subject above the predetermined level and to maintain the concentration of soluble Klotho protein in the bodily fluid of the subject above the predetermined level for the predetermined period of time, wherein the predetermined period of time is at least 6 hours; and
administering one or more subsequent dosage(s) of the pharmaceutical composition to the subject, wherein the step of administering one or more subsequent dosage(s) is sufficient to maintain the concentration of soluble Klotho protein in the bodily fluid of the subject above the predetermined level for an extended period of time, wherein the extended period of time is optionally at least 24 hours.

19. The method of claim 18 further comprising:
measuring a rate of soluble Klotho protein concentration decline in a bodily fluid of the subject following the administering step; and
calculating a time and/or amount of the one or more subsequent dosage(s).

20. A method of treating acute kidney injury or chronic kidney disease in a mammalian subject, the method comprising:
measuring a concentration of soluble Klotho protein in a bodily fluid of the subject;
calculating a first dosage of a pharmaceutical composition sufficient to raise the concentration of soluble Klotho protein in the bodily fluid of the subject above a predetermined level and to maintain the concentration of soluble Klotho protein in the bodily fluid of the subject above the predetermined level for a predetermined period of time, the pharmaceutical composition comprising:
a pharmaceutically acceptable carrier or excipient; and
an effective amount of a recombinant fusion protein comprising:
a synthetic signal sequence having at least 99% amino acid sequence identity to SEQ ID NO: 72;
a Klotho protein sequence having at least 99% amino acid sequence identity to SEQ ID NO: 4; and
an immunoglobulin Fc domain having at least 99% amino acid sequence identity to SEQ ID NO: 74; and
optionally, a linker disposed between the Klotho protein sequence and the immunoglobulin Fc domain;
administering the first dosage of the pharmaceutical composition to the mammalian subject, wherein the step of administering the first dosage is sufficient to raise the concentration of soluble Klotho protein in the bodily fluid of the subject above the predetermined level and to maintain the concentration of soluble Klotho protein in the bodily fluid of the subject above the predetermined level for the predetermined period of time, wherein the predetermined period of time is at least 6 hours; and
administering one or more subsequent dosage(s) of the pharmaceutical composition to the subject, wherein the step of administering one or more subsequent dosage(s) is sufficient to maintain the concentration of soluble Klotho protein in the bodily fluid of the subject above the predetermined level for an extended period of time, wherein the extended period of time is at least 24 hours.

* * * * *